US011078282B2

(12) United States Patent
Swanson et al.

(10) Patent No.: US 11,078,282 B2

(45) Date of Patent: Aug. 3, 2021

(54) CD80 VARIANT IMMUNOMODULATORY PROTEINS AND USES THEREOF

(71) Applicant: ALPINE IMMUNE SCIENCES, INC., Seattle, WA (US)

(72) Inventors: Ryan Swanson, Seattle, WA (US); Michael Kornacker, Seattle, WA (US)

(73) Assignee: ALPINE IMMUNE SCIENCES, INC., Seattle, WA (US)

( * ) Notice: Subject to any disclaimer, the term of this patent is extended or adjusted under 35 U.S.C. 154(b) by 0 days.

(21) Appl. No.: 16/088,802

(22) PCT Filed: Apr. 14, 2017

(86) PCT No.: PCT/US2017/027817
§ 371 (c)(1),
(2) Date: Sep. 26, 2018

(87) PCT Pub. No.: WO2017/181152
PCT Pub. Date: Oct. 19, 2017

(65) Prior Publication Data

US 2019/0135922 A1 May 9, 2019

Related U.S. Application Data

(60) Provisional application No. 62/323,595, filed on Apr. 15, 2016, provisional application No. 62/394,743, filed on Sep. 14, 2016, provisional application No. 62/410,844, filed on Oct. 20, 2016, provisional application No. 62/472,570, filed on Mar. 16, 2017, provisional application No. 62/475,201, filed on Mar. 22, 2017.

(51) Int. Cl.

| | |
|---|---|
| ***C07K 16/28*** | (2006.01) |
| ***C07K 14/705*** | (2006.01) |
| ***C12N 15/62*** | (2006.01) |
| ***A61K 47/65*** | (2017.01) |
| ***A61K 47/68*** | (2017.01) |
| ***A61K 47/64*** | (2017.01) |
| ***A61K 35/768*** | (2015.01) |
| ***C12N 15/85*** | (2006.01) |
| *A61P 37/00* | (2006.01) |
| *A61P 35/00* | (2006.01) |
| *A61K 38/17* | (2006.01) |

(52) U.S. Cl.
CPC ........ *C07K 16/2827* (2013.01); *A61K 35/768* (2013.01); *A61K 47/64* (2017.08); *A61K 47/65* (2017.08); *A61K 47/68* (2017.08); *C07K 14/70532* (2013.01); *C12N 15/62* (2013.01); *C12N 15/85* (2013.01); *A61K 38/1774* (2013.01); *A61P 35/00* (2018.01); *A61P 37/00* (2018.01)

(58) Field of Classification Search
None
See application file for complete search history.

(56) References Cited

U.S. PATENT DOCUMENTS

| | | | |
|---|---|---|---|
| 5,168,062 | A | 12/1992 | Stinski |
| 5,208,020 | A | 5/1993 | Chari et al. |
| 5,385,839 | A | 1/1995 | Stinski |
| 5,443,964 | A | 8/1995 | Pickup et al. |
| 5,500,362 | A | 3/1996 | Robinson et al. |
| 5,624,821 | A | 4/1997 | Winter et al. |
| 5,648,260 | A | 7/1997 | Winter et al. |
| 5,698,530 | A | 12/1997 | Schlom et al. |
| 5,716,613 | A | 2/1998 | Guber et al. |
| 5,716,826 | A | 2/1998 | Guber et al. |
| 5,731,168 | A | 3/1998 | Carter et al. |
| 5,767,071 | A | 6/1998 | Palladino et al. |
| 5,780,426 | A | 7/1998 | Palladino et al. |
| 5,821,337 | A | 10/1998 | Carter et al. |
| 5,851,529 | A | 12/1998 | Guber et al. |
| 5,885,796 | A | 3/1999 | Linsley et al. |
| 5,891,432 | A | 4/1999 | Hoo |
| 5,942,607 | A | 8/1999 | Freeman et al. |
| 5,998,205 | A | 12/1999 | Hallenbeck et al. |
| 6,084,067 | A | 7/2000 | Freeman et al. |
| 6,130,316 | A | 10/2000 | Freeman et al. |
| 6,143,290 | A | 11/2000 | Zhang et al. |
| 6,194,551 | B1 | 2/2001 | Idusogie et al. |
| 6,218,510 | B1 | 4/2001 | Sharpe et al. |
| 6,294,660 | B1 | 9/2001 | Sharpe et al. |
| 6,352,694 | B1 | 3/2002 | June et al. |

(Continued)

FOREIGN PATENT DOCUMENTS

| | | |
|---|---|---|
| EP | 0757099 | 2/1997 |
| EP | 1173204 | 1/2002 |

(Continued)

OTHER PUBLICATIONS

Sadelain, M. et al., "The basic principles of chimeric antigen receptor design." Cancer Discov., Apr. 2013, vol. 3, No. 4, pp. 388-398.
U.S. Appl. No. 16/493,750, filed Sep. 12, 2019, by Swanson et al.
U.S. Appl. No. 16/493,752, filed Sep. 12, 2019, by Swanson et al.
"Database accession No. A0A2K5E9H6," Retrieved from UNIPROT, https://www.uniprot.org/uniprot/A0A2K5E9H6. Retrieved Sep. 13, 2019.

(Continued)

*Primary Examiner* — Gary B Nickol
*Assistant Examiner* — Jegatheesan Seharaseyon
(74) *Attorney, Agent, or Firm* — Morrison & Foerster LLP

(57) ABSTRACT

Provided herein are variant CD80 polypeptides, immunomodulatory proteins comprising variant CD80 polypeptides, and nucleic acids encoding such proteins. The immunomodulatory proteins provide therapeutic utility for a variety of immunological and oncological conditions. Compositions and methods for making and using such proteins are provided.

33 Claims, 12 Drawing Sheets

Specification includes a Sequence Listing.

(56) References Cited

U.S. PATENT DOCUMENTS

| | | | |
|---|---|---|---|
| 6,365,619 | B1 | 4/2002 | Shi |
| 6,428,968 | B1 | 8/2002 | Molnar-Kimber et al. |
| 6,534,055 | B1 | 3/2003 | June et al. |
| 6,596,535 | B1 | 7/2003 | Carter |
| 6,632,670 | B1 | 10/2003 | Wadsworth et al. |
| 6,635,472 | B1 | 10/2003 | Lauermann |
| 6,635,750 | B1 | 10/2003 | Coyle et al. |
| 6,641,809 | B1 | 11/2003 | Linsley et al. |
| 6,653,103 | B2 | 11/2003 | Peterson et al. |
| 6,689,871 | B1 | 2/2004 | Wolfe et al. |
| 6,713,279 | B1 | 3/2004 | Short |
| 6,723,316 | B2 | 4/2004 | Laquerre et al. |
| 6,730,512 | B2 | 5/2004 | Chang |
| 6,737,056 | B1 | 5/2004 | Presta |
| 6,855,317 | B2 | 2/2005 | Koelle et al. |
| 6,887,471 | B1 | 5/2005 | Linsley et al. |
| 6,897,045 | B2 | 5/2005 | Engelhardt et al. |
| 6,936,257 | B1 | 8/2005 | Bennett |
| 6,998,252 | B1 | 2/2006 | Moss et al. |
| 7,001,765 | B2 | 2/2006 | Maass et al. |
| 7,033,826 | B2 | 4/2006 | Perricaudet et al. |
| 7,094,875 | B2 | 8/2006 | Punnonen et al. |
| 7,125,717 | B2 | 10/2006 | Carter |
| 7,153,510 | B1 | 12/2006 | Rose |
| 7,172,893 | B2 | 2/2007 | Rabinowitz et al. |
| 7,238,526 | B2 | 7/2007 | Wilson et al. |
| 7,241,447 | B1 | 7/2007 | Engelhardt et al. |
| 7,247,615 | B2 | 7/2007 | Schlom et al. |
| 7,332,581 | B2 | 2/2008 | Presta |
| 7,368,116 | B2 | 5/2008 | Schlom et al. |
| 7,371,826 | B2 | 5/2008 | Presta |
| 7,378,087 | B2 | 5/2008 | Jefferies et al. |
| 7,446,189 | B1 | 11/2008 | Weiner et al. |
| 7,455,835 | B2 | 11/2008 | Cohen et al. |
| 7,537,924 | B2 | 5/2009 | Coffin |
| 7,550,296 | B2 | 6/2009 | Hermiston et al. |
| 7,560,540 | B2 | 7/2009 | Pardoll et al. |
| 7,588,767 | B2 | 9/2009 | Szalay et al. |
| 7,588,771 | B2 | 9/2009 | Szalay et al. |
| 7,612,170 | B2 | 11/2009 | Punnonen et al. |
| 7,619,078 | B2 | 11/2009 | Sharpe et al. |
| 7,662,398 | B2 | 2/2010 | Szalay et al. |
| 7,662,627 | B2 | 2/2010 | Johnson et al. |
| 7,709,214 | B2 | 5/2010 | Freeman et al. |
| 7,722,868 | B2 | 5/2010 | Cohen et al. |
| 7,731,952 | B2 | 6/2010 | Mohr et al. |
| 7,731,974 | B2 | 6/2010 | Bell et al. |
| 7,754,221 | B2 | 7/2010 | Szalay et al. |
| 7,794,718 | B2 | 9/2010 | Karrer et al. |
| 7,811,814 | B2 | 10/2010 | Bohn et al. |
| 7,897,146 | B2 | 3/2011 | Brown et al. |
| 7,906,111 | B2 | 3/2011 | Wilson et al. |
| 7,927,585 | B2 | 4/2011 | Snyder |
| 7,943,374 | B2 | 5/2011 | Hildinger |
| 7,968,340 | B2 | 6/2011 | Hallek et al. |
| 8,007,780 | B2 | 8/2011 | Arbetman et al. |
| 8,053,414 | B2 | 11/2011 | Pardoll et al. |
| 8,053,558 | B2 | 11/2011 | Pardoll et al. |
| 8,202,847 | B2 | 6/2012 | Weiner et al. |
| 8,445,447 | B2 | 5/2013 | Chen |
| 8,911,726 | B2 | 12/2014 | Takahashi et al. |
| 8,956,619 | B2 | 2/2015 | Ostrand-Rosenberg |
| 9,103,831 | B2 | 8/2015 | O'Sullivan et al. |
| 9,453,227 | B2 | 9/2016 | Diamond et al. |
| 9,650,429 | B2 | 5/2017 | Ostrand-Rosenberg |
| 9,834,604 | B2 | 12/2017 | Zhu et al. |
| 2002/0168714 | A1 | 11/2002 | Barbas et al. |
| 2003/0083246 | A1 | 5/2003 | Cohen et al. |
| 2003/0138881 | A1 | 7/2003 | Punnonen et al. |
| 2003/0171551 | A1 | 9/2003 | Rosenblatt et al. |
| 2004/0009604 | A1 | 1/2004 | Zhang et al. |
| 2004/0063094 | A1 | 4/2004 | Coffin et al. |
| 2004/0072283 | A1 | 4/2004 | Seed et al. |
| 2004/0146488 | A1 | 7/2004 | Hu et al. |
| 2005/0014934 | A1 | 1/2005 | Hinton et al. |
| 2005/0220818 | A1 | 10/2005 | Lorence |
| 2005/0260601 | A1 | 11/2005 | Whitt et al. |
| 2006/0039894 | A1 | 2/2006 | Mohr et al. |
| 2007/0098743 | A1 | 5/2007 | Bell et al. |
| 2007/0110720 | A1 | 5/2007 | Brown et al. |
| 2007/0202572 | A1 | 8/2007 | Szalay et al. |
| 2007/0212727 | A1 | 9/2007 | Szalay et al. |
| 2009/0010889 | A1 | 1/2009 | Brown et al. |
| 2009/0053244 | A1 | 2/2009 | Chen et al. |
| 2009/0098529 | A1 | 4/2009 | Chen et al. |
| 2009/0117034 | A1 | 5/2009 | Chen et al. |
| 2009/0136917 | A1 | 5/2009 | Szalay et al. |
| 2009/0155287 | A1 | 6/2009 | Chen et al. |
| 2009/0162288 | A1 | 6/2009 | Chen et al. |
| 2009/0215147 | A1 | 8/2009 | Zhang et al. |
| 2009/0258031 | A1 | 10/2009 | Karrer et al. |
| 2009/0274728 | A1 | 11/2009 | Brown et al. |
| 2009/0285860 | A1 | 11/2009 | Martuza et al. |
| 2010/0062016 | A1 | 3/2010 | Szalay et al. |
| 2010/0092515 | A1 | 4/2010 | Conner et al. |
| 2010/0113567 | A1 | 5/2010 | Barber |
| 2010/0172877 | A1 | 7/2010 | van den Pol et al. |
| 2010/0178684 | A1 | 7/2010 | Woo et al. |
| 2010/0196325 | A1 | 8/2010 | Szalay et al. |
| 2010/0233078 | A1 | 9/2010 | Szalay et al. |
| 2010/0261660 | A1 | 10/2010 | Punnonen |
| 2011/0002956 | A1 | 1/2011 | Weiner et al. |
| 2011/0064650 | A1 | 3/2011 | Szalay |
| 2011/0064763 | A1 | 3/2011 | Allen et al. |
| 2011/0158948 | A1 | 6/2011 | Brown et al. |
| 2011/0177032 | A1 | 7/2011 | Martuza |
| 2011/0212530 | A1 | 9/2011 | Baltimore et al. |
| 2011/0293705 | A1 | 12/2011 | Irvine et al. |
| 2013/0017199 | A1 | 1/2013 | Langermann |
| 2013/0149305 | A1 | 6/2013 | Ostrand-Rosenberg |
| 2014/0056890 | A1 | 2/2014 | Gurney et al. |
| 2014/0154216 | A1 | 6/2014 | Coffin |
| 2014/0186380 | A1 | 7/2014 | Gurney et al. |
| 2014/0186401 | A1 | 7/2014 | Diamond et al. |
| 2014/0308299 | A1 | 10/2014 | Allison et al. |
| 2014/0322129 | A1 | 10/2014 | Leong et al. |
| 2014/0348832 | A1 | 11/2014 | Zhu et al. |
| 2015/0216970 | A1 | 8/2015 | Grogan et al. |
| 2015/0232532 | A1 | 8/2015 | Ostrand-Rosenberg |
| 2015/0359909 | A1 | 12/2015 | O'Sullivan et al. |
| 2016/0017041 | A1 | 1/2016 | Violette et al. |
| 2016/0339066 | A1 | 11/2016 | Szalay et al. |
| 2016/0346368 | A1 | 12/2016 | Gurney et al. |
| 2017/0145071 | A1 | 5/2017 | Brennan et al. |
| 2017/0226181 | A1 | 8/2017 | Ostrand-Rosenberg |
| 2018/0244749 | A1 | 8/2018 | Swanson et al. |
| 2018/0256644 | A1 | 9/2018 | Swanson et al. |
| 2019/0175654 | A1 | 6/2019 | Swanson et al. |

FOREIGN PATENT DOCUMENTS

| | | |
|---|---|---|
| EP | 1385466 | 2/2004 |
| EP | 1391213 | 2/2004 |
| EP | 1520175 | 4/2005 |
| EP | 1606411 | 12/2005 |
| EP | 3020816 | 5/2016 |
| WO | WO-1994/011026 | 5/1994 |
| WO | WO-1994/029351 | 12/1994 |
| WO | WO-1998/050431 | 11/1998 |
| WO | WO-1999/038955 | 8/1999 |
| WO | WO-1999/051642 | 10/1999 |
| WO | WO-2000/042072 | 7/2000 |
| WO | WO-2001/030843 | 5/2001 |
| WO | WO-2002/000717 | 1/2002 |
| WO | WO-2002/19898 | 3/2002 |
| WO | WO-2004/029197 | 4/2004 |
| WO | WO-2004/056312 | 7/2004 |
| WO | WO-2005/063816 | 7/2005 |
| WO | WO-2005/100402 | 10/2005 |
| WO | WO-2006/019447 | 2/2006 |
| WO | WO-2006/029879 | 3/2006 |
| WO | WO-2007/052029 | 5/2007 |
| WO | WO-2008/011636 | 1/2008 |
| WO | WO-2008/047150 | 4/2008 |

(56) References Cited

FOREIGN PATENT DOCUMENTS

| | | |
|---|---|---|
| WO | WO-2008/092117 | 7/2008 |
| WO | WO-2009/029342 | 3/2009 |
| WO | WO-2009/067800 | 6/2009 |
| WO | WO-2009/076524 | 6/2009 |
| WO | WO-2009/126688 | 10/2009 |
| WO | WO-2010/027423 | 3/2010 |
| WO | WO-2010/027827 | 3/2010 |
| WO | WO-2010/027828 | 3/2010 |
| WO | WO-2011/020024 | 2/2011 |
| WO | WO-2011/056983 | 5/2011 |
| WO | WO-2011/066342 | 6/2011 |
| WO | WO-2011/113019 | 9/2011 |
| WO | WO-2011/133886 | 10/2011 |
| WO | WO-2012/125850 | 9/2012 |
| WO | WO-2012/141984 | 10/2012 |
| WO | WO-2012/149364 | 11/2012 |
| WO | WO-2013/003761 | 1/2013 |
| WO | WO-2013/130683 | 9/2013 |
| WO | WO-2013/169338 | 11/2013 |
| WO | WO-2013/184912 | 5/2014 |
| WO | WO-2014/089169 | 9/2014 |
| WO | WO-2014/198002 | 12/2014 |
| WO | WO-2014/207063 | 12/2014 |
| WO | WO-2015/009856 | 1/2015 |
| WO | WO-2015/107026 | 7/2015 |
| WO | WO-2016/011083 | 1/2016 |
| WO | WO-2016/011264 | 1/2016 |
| WO | WO-2016/027995 | 2/2016 |
| WO | WO-2016/073704 | 5/2016 |
| WO | WO-2016/164428 | 10/2016 |
| WO | WO-2016/168771 | 10/2016 |
| WO | WO-2017/023749 | 2/2017 |
| WO | WO-2017/023779 | 2/2017 |
| WO | WO-2017/027817 | 2/2017 |
| WO | WO-2017/029389 | 2/2017 |
| WO | WO-2017/048878 | 3/2017 |
| WO | WO-2017/055547 | 4/2017 |
| WO | WO-2017/079117 | 5/2017 |
| WO | WO-2017/151818 | 9/2017 |
| WO | WO-2017/181148 | 10/2017 |
| WO | WO-2017/181152 | 10/2017 |
| WO | WO-2017/201131 | 11/2017 |
| WO | WO-2017/201210 | 11/2017 |
| WO | WO-2018/022945 | 2/2018 |
| WO | WO-2018/022946 | 2/2018 |
| WO | WO-2018/075978 | 4/2018 |
| WO | WO-2018/170021 | 9/2018 |
| WO | WO-2018/170023 | 9/2018 |
| WO | WO-2018/170026 | 9/2018 |
| WO | WO-2019/136179 | 7/2019 |
| WO | WO2019241758 A1 | 12/2019 |
| WO | WO2020061376 A2 | 3/2020 |

OTHER PUBLICATIONS

"Database accession No. BDH56778", Retrieved from GENESEQ, Retrieved on Sep. 13, 2019.

"Database accession No. BDV07959," Retrieved from GENESEQ, Retrieved on Sep. 12, 2019.

Chakrabarti et al., "A mutant B7-1/Ig fusion protein that selectively binds to CTLA-4 ameliorates anti-tumor DNA vaccination and counters regulatory T cell activity", Vaccine, Elsevier, Amsterdam , NL, vol. 23, No. 37, Aug. 31, 2005 pp. 4553-4564.

Fargeas et al., "Identification of residues in the V domain of CD80 (B7-1) implicated in functional interaction with CD28 and CTLA4", Journal of Experimental Medicine, vol. 182, No. 3. Sep. 1, 1995 pp. 667-675.

Maute et al., "Engineering high-affinity PD-1 variants for optimized immunotherapy and immuno-PET imaging," Proc Natl Acad Sci U S A. (2015) 112(47): E6506-14.

Nygren, "Conjugation of horseradish peroxidase to Fab fragments with different homobifunctional and heterobifunctional cross-linking reagents. A comparative study," J. Histochem Cytochem. May 1982;30(5):407-12.

Wade et al., "Genome sequence, comparative analysis, and population genetics of the domestic horse," Science. Nov. 6, 2009;326(5954):865-7.

Wu et al., "CTLA-4-87 Interaction Is Sufficient to Costimulate T Cell Clonal Expansion," J. Exp. Med. (1997) 185 (7):1327-1335.

U.S. Appl. No. 16/320,981, filed Jan. 25, 2019, by Swanson et al.

U.S. Appl. No. 16/321,000, filed Jan. 25, 2019, by Swanson et al.

U.S. Appl. No. 16/343,709, filed Apr. 19, 2019, by Swanson et al.

"Database accession No. A9UFX3," version 38. Retrieved from UNIPROT, http://www.uniprot.org/uniprot/A9UFX3.txt?. Retrieved on Jan. 18, 2018.

"Database accession No. ADM18706." Retrieved from IBIS, http://ibis/exam/dbfetch.jsp?id=GSP:ADM18706. Retrieved on Oct. 10, 2017.

"Database accession No. ADM18913." Retrieved from IBIS, http://ibis/exam/dbfetch.jsp?id=GSP:ADM18913. Retrieved on Oct. 10, 2017.

"Database accession No. B3TFD9," version 63. Retrieved from UNIPROT, http://www.uniprot.org/uniprot/B3TFD9.txt?version=63. Retrieved on Dec. 10, 2017.

"Database accession No. BCD07227." Retrieved from IBIS, http://ibis/exam/dbfetch.jsp?id=GSP:BCD07227. Retrieved on Oct. 10, 2017.

"Database accession No. BCD07228." Retrieved from IBIS, http://ibis/exam/dbfetch.jsp?id=GSP:BCD07228. Retrieved on Oct. 10, 2017.

"Database accession No. BD020821," Retrieved from GENESEQ, https://www.ebi.ac.uk/ena/data/view/BD020821. Retrieved on May 16, 2018.

"Database accession No. BD020825," Retrieved from GENESEQ, https://www.ebi.ac.uk/ena/data/view/BD020825. Retrieved on May 16, 2018.

"Database accession No. F1PWL4," version 43. Retrieved from UNIPROT, http://www.uniprot.org/uniprot/F1PWL4.txt?version=43. Retrieved on Dec. 10, 2017.

"Database accession No. F7D276," version 32. Retrieved from UNIPROT, http://www.uniprot.org/uniprot/F7DZ76. Retrieved on Jun. 6, 2018.

"Database accession No. G1SUI3," version 36. Retrieved from UNIPROT, http://www.uniprot.org/uniprot/G1SUI3.txt. Retrieved on Jun. 6, 2018.

"Database accession No. P32506," version 99. Retrieved from UNIPROT, http://www.uniprot.org/uniprot/P32506.txt?. Retrieved on Jan. 18, 2018.

Baban et al., "Bacteria as vectors for gene therapy of cancer," Bioeng Bugs. (2010) 1(6):385-394.

Benson et al., "GenBank," Nucleic Acids Res (2013) 41(Database issue):D36-D42.

Brown et al., "Structure-based mutagenesis of the human immunodeficiency virus type 1 DNA attachment site: effects on integration and cDNA synthesis," J Virol. (1999) 73(11):9011-9020.

Bruggemann et al., "Comparison of the effector functions of human immunoglobulins using a matched set of chimeric antibodies," J Exp Med. (1987) 166(5):1351-1361.

Buchschacher et al., "Human immunodeficiency virus vectors for inducible expression of foreign genes," J Virol. (1992) 66(5):2731-2739.

Chang et al., "The discovery of small molecule carbamates as potent dual alpha(4)beta(1)/alpha(4)beta(7) integrin antagonists," Bioorg Med Chem Lett. Jan. 21, 2002;12(2):159-63.

Chari et al., "Immunoconjugates containing novel maytansinoids: promising anticancer drugs," Cancer Res. (1992) 52(1):127-131.

Clynes et al., "Fc receptors are required in passive and active immunity to melanoma," Proc Natl Acad Sci U S A. (1998) 95(2):652-656.

Colby et al., "Engineering antibody affinity by yeast surface display," Methods Enzymol. 2004; 388:348-58.

Colcher et al., "Use of monoclonal antibodies as radiopharmaceuticals for the localization of human carcinoma xenografts in athymic mice," Methods Enzymol. (1986);121:802-16.

Condomines et al., "Tumor-Targeted Human T Cells Expressing CD28-Based Chimeric Antigen Receptors Circumvent CTLA-4 Inhibition," PLoS One (2015) 10(6):e0130518.

(56) References Cited

OTHER PUBLICATIONS

Cornetta et al., "No retroviremia or pathology in long-term follow-up of monkeys exposed to a murine amphotropic retrovirus," Hum Gene Ther. (1991) Fall;2(3):215-9.
Cragg et al., "Antibody specificity controls in vivo effector mechanisms of anti-CD20 reagents," Blood. (2004)103(7):2738-2743.
Cragg et al., "Complement-mediated lysis by anti-CD20 mAb correlates with segregation into lipid rafts," Blood. (2003) 101(3):1045-1052.
David et al., "Protein iodination with solid state lactoperoxidase," Biochemistry. Feb. 26, 1974;13(5):1014-21.
Deisenhofer et al., "Crystallographic refinement and atomic models of a human Fc fragment and its complex with fragment B of protein A from *Staphylococcus aureus* at 2.9- and 2.8-A resolution," Biochemistry. Apr. 28, 1981;20(9):2361-70.
Duncan et al., "The binding site for C1q on IgG," Nature. Apr. 21, 1988;332(6166):738-40.
Engelman et al., "Multiple effects of mutations in human immunodeficiency virus type 1 integrase on viral replication," J Virol. 1995 69(5):2729-2736.
Evans et al., "Generation of Novel Immuno-Oncology Biologics via Directed Evolution of Variant IgSF Domains," Poster Presentation for Immune Checkpoint Inhibitors, Boston, MA (Mar. 14-16, 2017) 1 page.
Evans et al., "Therapeutic T Cell Activation Using Engineered Variant IgSF Domains," Poster presented at Society for Immunotherapy of Cancer, National Harbor, MD, (Nov. 9-13, 2016) 1 page.
Evans et al., "Novel immunomodulatory proteins generated via directed evolution of variant IgSF domains," Abstract for AAI Immunology 2017, Washington D.C. (May 12-16, 2017) 1 page.
Evans et al., "Novel immunomodulatory proteins generated via directed evolution of variant IgSF domains," Poster for AAI Immunology 2017, Washington D.C. (May 12-16, 2017) 1 page.
Ford et al., "Targeting co-stimulatory pathways: transplantation and autoimmunity," Nat Rev Nephrol. (2014) 10(1):14-24.
Fraker et al., "Protein and cell membrane iodinations with a sparingly soluble chloroamide, 1,3,4,6-tetrachloro-3a,6a-diphrenylglycoluril," Biochem Biophys Res Commun. Feb. 28, 1978;80(4):849-57.
Garcia-Aragoncillo et al., "Design of virotherapy for effective tumor treatment," Curr Opin Mol Ther. Aug. 2010;12(4):403-11.
Gazzano-Santoro et al., "A non-radioactive complement-dependent cytotoxicity assay for anti-CD20 monoclonal antibody," J Immunol Methods. Mar. 28, 1997;202(2):163-71.
Gherardi et al., "Recombinant poxviruses as mucosal vaccine vectors," J Gen Virol. (2005) 86(Pt 11):2925-2936.
Guerra et al., "Host response to the attenuated poxvirus vector NYVAC: upregulation of apoptotic genes and NF-kappaB-responsive genes in infected HeLa cells," J Virol. Jan. 2006;80(2):985-98.
Haile et al., "A Soluble Form of CD80 Enhances Antitumor Immunity by Neutralizing Programmed Death Ligand-1and Simultaneously Providing Costimulation," Cancer Immunol Res (2014) 2(7): 610-615.
Hallden et al., "Oncolytic virotherapy with modified adenoviruses and novel therapeutic targets," Expert Opin Ther Targets. Oct. 2012;16(10):945-58.
Harris et al., "CD80 costimulation is essential for the induction of airway eosinophilia," J Exp Med. Jan. 6, 1997;185(1):177-82.
Hellstrom et al., "Antitumor effects of L6, an IgG2a antibody that reacts with most human carcinomas," Proc Natl Acad Sci U S A. (1986) 83(18):7059-7063.
Hellstrom et al., "Strong antitumor activities of IgG3 antibodies to a human melanoma-associated ganglioside," Proc Natl Acad Sci U S A. (1985) 82(5):1499-1502.
Hinman et al., "Preparation and characterization of monoclonal antibody conjugates of the calicheamicins: a novel and potent family of antitumor antibiotics," Cancer Res. (1993) 53(14):3336-3342.
Hu et al., "Yaba-like disease virus: an alternative replicating poxvirus vector for cancer gene therapy," J Virol. (2001) 75(21):10300-10308.
Hunter et al., "Preparation of iodine-131 labelled human growth hormone of high specific activity," Nature. May 5, 1962;194:495-6.
Idusogie et al., "Mapping of the C1g binding site on rituxan, a chimeric antibody with a human IgG1 Fc," J Immunol. (2000) 164(8):4178-4184.
IMGT Scientific Chart, "Correspondence between the IMGT unique numbering for C-DOMAIN, the IMGT exon numbering, the Eu and Kabat numberings: Human IGHG," Last updated Aug. 6, 2016. Retrieved from http://www.imgt.org/IMGTScientificChart/Numbering/Hu_IGHGnber.html.
Infante et al., "Overview Clinical and Pharmacodynamic (PD) Results of a Phase 1 Trial with AMP-224 (B7-DC Fc) that Binds to the PD-1 Receptor," Journal of Clinical Oncology (2013) 31(15_suppl):3044-3044.
Johann et al., "GLVR1, a receptor for gibbon ape leukemia virus, is homologous to a phosphate permease of Neurospora crassa and is expressed at high levels in the brain and thymus," J Virol. (1992) 66(3):1635-1640.
Khalil et al., "The future of cancer treatment: immunomodulation, CARs and combination immunotherapy," Nat Rev Clin Oncol. (2016) 13(5):273-90.
Khan et al., "Characterization of the New World monkey homologues of human poliovirus receptor CD155," J Virol. Jul. 2008;82(14):7167-79.
Kirn et al., "Targeted and armed oncolytic poxviruses: a novel multi-mechanistic therapeutic class for cancer," Nat Rev Cancer. Jan. 2009;9(1):64-71.
Koike et al., "A second gene for the African green monkey poliovirus receptor that has no putative N-glycosylation site in the functional N-terminal immunoglobulin-like domain," J Virol. Dec. 1992;66(12):7059-66.
Kojima et al., "Fusion Protein of Mutant B7-DC and Fc Enhances the Antitumor Immune Effect of GM-CSF-secreting Whole-cell Vaccine," J Immunother. (2014) 37(3):147-54.
Kolberg, " Gene-transfer virus contaminant linked to monkey's cancer," J NIH Res. (1992) 4:4344.
Labrijn et al., "Therapeutic IgG4 antibodies engage in Fab-arm exchange with endogenous human IgG4 in vivo," Nat Biotechnol. Aug. 2009;27(8):767-71.
Larsen et al., "Rational development of LEA29Y (belatacept), a high-affinity variant of CTLA4-Ig with potent immunosuppressive properties," Am J Transplant. Mar. 2005;5(3):443-53.
Lazetic et al., "Chimeric co-stimulatory molecules that selectively act through CD28 or CTLA-4 on human T cells," J Biol Chem (2002)11;277(41):38660-38668.
Leabman et al., "Effects of altered FcγR binding on antibody pharmacokinetics in cynomolgus monkeys," MAbs. (2013) 5(6):896-903.
Levin et al., "Novel Immunomodulatory Proteins Generated Via Directed Evolution of Variant IgSF Domains," Abstract for Keystone Symposia: Immune Regulation in Autoimmunity and Cancer, Whistler, British Columbia, Canada (Mar. 26-30, 2017), 1 page.
Levin et al., "Novel Immunomodulatory Proteins Generated Via Directed Evolution of Variant IgSF Domains," Poster presentation for Keystone Symposia: Immune Regulation in Autoimmunity and Cancer, Whistler, British Columbia, Canada (Mar. 26-30, 2017), 1 page.
Li et al., "Comparison of anti-CD3 and anti-CD28-coated beads with soluble anti-CD3 for expanding human T cells: differing impact on CD8 T cell phenotype and responsiveness to restimulation," J Transl Med. (2010) 8:104.
Li et al., "Structure of the human activating natural cytotoxicity receptor NKp30 bound to its tumor cell ligand B7-H6," J Exp Med (2011) 208(4): 703-714.
Lin et al., "Specific and dual antagonists of alpha(4)beta(1) and alpha(4)beta(7) integrins," Bioorg Med Chem Lett. Jan. 21, 2002;12(2):133-6.
Lin et al., "The PD-1/PD-L1 complex resembles the antigen-binding Fv domains of antibodies and T cell receptors," Proc Natl Acad Sci U S A. (2008) 105(8):3011-3016.

(56) References Cited

OTHER PUBLICATIONS

Lindblad-Toh et al., "A high-resolution map of human evolutionary constraint using 29 mammals," Nature (2011) 478(7370):476-482.
Lindblad-Toh et al., "Genome sequence, comparative analysis and haplotype structure of the domestic dog," Nature. Dec. 8, 2005;438(7069):803-19.
Linsley et al., "Human B7-1 (CD80) and B7-2 (CD86) bind with similar avidities but distinct kinetics to CD28 and CTLA-4 receptors," Immunity. Dec. 1994;1(9):793-801.
Lipson EJ, Forde PM, Hammers HJ, Emens LL, Taube JM, Topalian SL. Antagonists of PD-1 and PD-L1 in Cancer Treatment. *Semin Oncol.* Aug. 2015;42(4):587-600.
Liu et al., "Crystal structure of cell adhesion molecule nectin-2/CD112 and its binding to immune receptor DNAM-1/CD226," J Immunol. Jun. 1, 2012;188(11):5511-20.
Liu et al., "Eradication of large colon tumor xenografts by targeted delivery of maytansinoids," Proc Natl Acad Sci U S A. (1996) 93(16):8618-8623.
Lode et al., "Targeted therapy with a novel enediyene antibiotic calicheamicin theta(I)1 effectively suppresses growth and dissemination of liver metastases in a syngeneic model of murine neuroblastoma," Cancer Res. (1998) 58(14):2925-2928.
Mandler et al., "Immunoconjugates of geldanamycin and anti-HER2 monoclonal antibodies: antiproliferative activity on human breast carcinoma cell lines," J Natl Cancer Inst. Oct. 4, 2000;92(19):1573-81.
Mandler et al., "Modifications in synthesis strategy improve the yield and efficacy of geldanamycin-herceptin immunoconjugates," Bioconjug Chem. Jul.-Aug. 2002;13(4):786-91.
Mandler et al., "Synthesis and evaluation of antiproliferative activity of a geldanamycin-Herceptin immunoconjugate," Bioorg Med Chem Lett. May 15, 2000;10(10):1025-8.
Mayr et al., "Passage history, properties, and applicability of the attenuated vaccinia virus strain MVA," Infection. (1975);3:6-14. (English translation of abstract provided).
McLoughlin et al., "TNFerade, an adenovector carrying the transgene for human tumor necrosis factor alpha, for patients with advanced solid tumors: surgical experience and long-term follow-up," Ann Surg Oncol. Oct. 2005;12(10):825-30.
McWilliams et al., "Mutations in the 5' end of the human immunodeficiency virus type 1 polypurine tract affect RNase H cleavage specificity and virus titer," J Virol. (2003) 77(20):11150-11157.
Merchant et al., "An efficient route to human bispecific IgG," Nat Biotechnol. Jul. 1998;16(7):677-81.
Mercier et al., "A chimeric adenovirus vector encoding reovirus attachment protein sigmal targets cells expressing junctional adhesion molecule 1," Proc Natl Acad Sci U S A. (2004) 101(16):6188-6193.
Miller et al., "Construction and properties of retrovirus packaging cells based on gibbon ape leukemia virus," J Virol. (1991) 65(5):2220-2224.
Miller et al., "Construction and screening of antigen targeted immune yeast surface display antibody libraries," Curr Protoc Cytom. Jul. 2008;Chapter 4:Unit4.7.
Miller et al., "Gene transfer by retrovirus vectors occurs only in cells that are actively replicating at the time of infection," Mol Cell Biol. (1990) 10(8):4239-4242.
Miller, "Protein-protein recognition and the association of immunoglobulin constant domains," J Mol Biol. Dec. 20, 1990;216(4):965-73.
Milone et al., "Chimeric receptors containing CD137 signal transduction domains mediate enhanced survival of T cells and increased antileukemic efficacy in vivo," Mol Ther. (2009) 17(8):1453-64.
Miyoshi et al. "Development of a self-inactivating lentivirus vector," J Virol. (1998) 72(10):8150-8157.
Molin et al., "Two novel adenovirus vector systems permitting regulated protein expression in gene transfer experiments," J Virol. (1998) 72(10):8358-8361.
Morton et al., "Differential effects of CTLA-4 substitutions on the binding of human CD80 (B7-1) and CD86 (B7-2)," J Immunol. (1996) 156(3):1047-1054.
Narumi et al., "Adenovirus vector-mediated perforin expression driven by a glucocorticoid-inducible promoter inhibits tumor growth in vivo," Am J Respir Cell Mol Biol. (1998) 19(6):936-941.
Nightingale et al., "Transient gene expression by nonintegrating lentiviral vectors," Mol Ther. (2006) 13(6):1121-1132.
Nishimori et al., "Identification and characterization of bovine programmed death-ligand 2," Microbiol Immunol. (2014) 58(7):388-97.
Pain et al., "Preparation of protein A-peroxidase monoconjugate using a heterobifunctional reagent, and its use in enzyme immunoassays," J Immunol Methods. (1981);40(2):219-30.
Patyar et al., "Bacteria in cancer therapy: a novel experimental strategy," J Biomed Sci. (2010) 17(1):21.
Peach et al., "Both extracellular immunoglobin-like domains of CD80 contain residues critical for binding T cell surface receptors CTLA-4 and CD28," J Biol Chem. (1995) 270(36):21181-7.
Penix et al., "Two essential regulatory elements in the human interferon gamma promoter confer activation specific expression in T cells," J Exp Med. (1993) 178(5):1483-1496.
Peper et al., "An impedance-based cytotoxicity assay for real-time and label-free assessment of T-cell-mediated killing of adherent cells," J Immunol Methods. Mar. 2014;405:192-8.
Pérez De La Lastra et al., "Epitope mapping of 10 monoclonal antibodies against the pig analogue of human membrane cofactor protein (MCP)," Immunology. (1999) 96(4):663-70.
Petkova et al., "Enhanced half-life of genetically engineered human IgG1 antibodies in a humanized FcRn mouse model: potential application in humorally mediated autoimmune disease," Int Immunol. (2006) 18(12):1759-1769.
Pfeifer et al., "Gene therapy: promises and problems," Annu Rev Genomics Hum Genet. (2001);2:177-211.
Philpott et al., "Use of nonintegrating lentiviral vectors for gene therapy," Hum Gene Ther. Jun. 2007;18(6):483-9.
Powell et al., "Sequence and structural determinants required for priming of plus-strand DNA synthesis by the human immunodeficiency virus type 1 polypurine tract," J Virol. (1996) 70(8):5288-5296.
Protein Data Bank, "1I8L, Human B7-1/CTLA-4 Co-Stimulatory Complex," Released on Apr. 4, 2001. Retrieved from https://www.rcsb.org/structure/1I8L.
Qin et al., "Incorporation of a hinge domain improves the expansion of chimeric antigen receptor T cells," J Hematol Oncol. (2017) 10(1):68.
Ravetch et al., "Fc receptors," Annu Rev Immunol. (1991);9:457-92.
Ridgway et al., "'Knobs-into-holes' engineering of antibody CH3 domains for heavy chain heterodimerization," Protein Eng. Jul. 1996;9(7):617-21.
Rosenberg et al., "Use of tumor-infiltrating lymphocytes and interleukin-2 in the immunotherapy of patients with metastatic melanoma. A preliminary report," N Engl J Med. (1988) 319(25):1676-1680.
Rowland et al., "Drug localisation and growth inhibition studies of vindesine-monoclonal anti-CEA conjugates in a human tumour xenograft," Cancer Immunol Immunother. (1986);21(3):183-7.
Seow et al., "Biological gene delivery vehicles: beyond viral vectors," Mol Ther. (2009) 17(5):767-777.
Shields et al., "High resolution mapping of the binding site on human IgG1 for Fc gamma RI, Fc gamma RII, Fc gamma RIII, and FcRn and design of IgG1 variants with improved binding to the Fc gamma R," J Biol Chem. (2001) 276(9):6591-6604.
Sommerfelt et al., "Receptor interference groups of 20 retroviruses plating on human cells," Virology. May 1990;176(1):58-69.
Srinivasan et al., "Immunomodulatory peptides from IgSF proteins: a review," Curr Protein Pept Sci. (2005) 6(2):185-96.
Stamper et al., "Crystal structure of the B7-1/CTLA-4 complex that inhibits human immune responses," Nature. (2001) 410(6828):608-611.

(56) References Cited

OTHER PUBLICATIONS

Tangney et al., "The use of Listeria monocytogenes as a DNA delivery vector for cancer gene therapy," Bioeng Bugs. (2010) 1(4):284-287.
Tartaglia et al., "Highly attenuated poxvirus vectors," AIDS Res Hum Retroviruses. (1992) 8(8):1445-1447.
Terawaki et al., "Specific and high-affinity binding of tetramerized PD-L1 extracellular domain to PD-1-expressing cells: possible application to enhance T cell function," Int Immunol (2007) 19(7):881-890.
Thompson et al., "Cis-acting sequences required for inducible interleukin-2 enhancer function bind a novel Ets-related protein, Elf-1," Mol Cell Biol. (1992) 12(3):1043-1053.
Todd et al., "Transcription of the interleukin 4 gene is regulated by multiple promoter elements," J Exp Med. (1993) 177(6):1663-1674.
Vafa et al., "An engineered Fc variant of an IgG eliminates all immune effector functions via structural perturbations," Methods. (2014) 65(1):114-26.
Van Pijkeren et al., "A novel Listeria monocytogenes-based DNA delivery system for cancer gene therapy," Hum Gene Ther. Apr. 2010;21(4):405-16.
Vitetta et al., "Redesigning nature's poisons to create anti-tumor reagents," Science. Nov. 20, 1987;238(4830):1098-104.
Wang et al., "In vitro characterization of the anti-PD-1 antibody nivolumab, BMS-936558, and in vivo toxicology in non-human primates," Cancer Immunol Res. (2014) 2(9):846-856.
Wang et al., "Molecular cloning, characterization and three-dimensional modeling of porcine nectin-2/CD112," Vet Immunol Immunopathol. 2009 132(2-4):257-63.
Wang et al., "Molecular modeling and functional mapping of B7-H1 and B7-DC uncouple costimulatory function from PD-1 interaction," J Exp Med. 2003 197(9):1083-91.
Wilson et al., "Formation of infectious hybrid virions with gibbon ape leukemia virus and human T-cell leukemia virus retroviral envelope glycoproteins and the gag and pol proteins of Moloney murine leukemia virus," J Virol. (1989) 63(5):2374-2378.
Wu et al., "IL-24 modulates IFN-gamma expression in patients with tuberculosis," Immunol Lett. (2008) 117(1):57-62.
Xu et al., "Affinity and cross-reactivity engineering of CTLA4-Ig to modulate T cell costimulation," J Immunol (2012) 189(9):4470-4477.
Zhang et al., "Introduction to the Data Analysis of the Roche xCELLigence®System with RTCA Package," Bioconductor. May 3, 2016, bioconductor.org/packages/devel/bioc/vignettes/RTCA/inst/doc/aboutRTCA.pdf, accessed Sep. 9, 2016, 11 pages.
Zhao et al., "A Bispecific Protein Capable of Engaging CTLA-4 and MHCII Protects Non-Obese Diabetic Mice from Autoimmune Diabetes," PLoS One (2013) 8(5):e63530-e63530.
Zhao et al., "Structural Design of Engineered Costimulation Determines Tumor Rejection Kinetics and Persistence of CAR T Cells," Cancer Cell (2015) 28(4):415-428.
Zhao et al., "TIGIT overexpression diminishes the function of CD4 T cells and ameliorates the severity of rheumatoid arthritis in mouse models," Exp Cell Res. Jan. 1, 2016;340(1):132-8.
Zufferey et al., "Self-inactivating lentivirus vector for safe and efficient in vivo gene delivery," J Virol. (1998) 72(12):9873-9880.
U.S. Appl. No. 16/959,662, filed Jan. 3, 2019, by Swanson et al.
U.S. Appl. No. 16/493,751, filed Sep. 12, 2019, by Swanson et al.
Butte et al., "Programmed death-1 ligand 1 interacts specifically with the B7-1 costimulatory molecule to inhibit T cell responses," Immunity (2007) 27(1):111-122.
Chen et al., "MolProbity: all-atom structure validation for macromolecular crystallography," Acra Crystallogr D Biol Crystallogr (2010) 66(Pt 1):12-21.
Davis et al., "Macrophage M1/M2 polarization dynamically adapts to changes in cytokine microenvironments in Cryptococcus neoformans infection," M Bio (2013) 4(3):e00264.
De Filipe et al., "Use of the 2A sequence from foot-and-mouth disease virus in the generation of retroviral vectors for gene therapy," Gene Therapy (1999) 6:198-208.
Dull et al., "A Third-Generation Lentivirus Vector with a Conditional Packaging System," J Virology (1998) 72(11): 8463-8471.
Emsley et al., "Features and development of Coot," Acta Crystallogr D Biol Crystallogr (2010) 66(Pt 4):486-501.
Evans et al., "Crystal structure of a soluble CD28-Fab complex," Nat Immunol (2005) 6(3):271-279.
Freeman et al., "Engagement of the PD-1 immunoinhibitory receptor by a novel B7 family member leads to negative regulation of lymphocyte activation," J Exp Med (2000) 192(7):1027-1034.
Gill et al., "Calculation of protein extinction coefficients from amino acid sequence data," Anal Biochem (1989) 182(2):319-326.
Hezareh et al., "Effector function activities of a panel of mutants of a broadly neutralizing antibody against human immunodeficiency virus type 1," J Virol (2001) 75(24):12161-12168.
Hu et al., "The M2 phenotype of tumor-associated macrophages in the stroma confers a poor prognosis in pancreatic cancer," Tumour Biol (2016) 37(7):8657-8764.
Hui et al., "T cell costimulatory receptor CD28 is a primary target for PD-1-mediated inhibition," Science (2017) 355(6332):1428-1433.
Ikemizu et al., "Structure and Dimerization of a Soluble Form of B7-1," Immunity (2000) 12:51-60.
Im et al., "Defining CD8+ T cells that provide the proliferative burst after PD-1 therapy," Nature (2016) 537(7620):417-421.
Intlekofer et al., "At the bench: preclinical rationale for CTLA-4 and PD-1 blockade as cancer immunotherapy," J Leukoc biol (2013) 94(1):25-39.
Kabsch et al., "XDS" Acta Crystallogr D Biol Crystallogr, 2010. 66(Pt 2): p. 125-32.
Kamphorst et al., "Rescue of exhausted CD8 T cells by PD-1-targeted therapies is CD28-dependent," Science (2017) 355(6332):1423-1427.
Lee et al., "Molecular mechanism of PD-1/PD-L1 blockade via anti-PD-L1 antibodies atezolizumab and durvalunnab," Sci Rep (2017) 7(1):5532.
Leitner et al., "T cell stimulator cells, an efficient and versatile cellular system to assess the role of costimulatory ligands in the activation of human T cells," J Immunol Methods (2010) 362(1-2):131-141.
Lewis et al., "Novel immunomodulatory proteins generated via directed evolution of variant IgSF domains," Poster Presentation at the Federation of Clinical Immunology Societies Meeting, Chicago IL (Jun. 14, 2017).
Mantovani et al., "Tumour-associated macrophages as treatment targets in oncology," Nat Rev Clin Oncol (2017) 14(7):399-416.
Murshudov et al., "REFMAC5 for the refinement of macromolecular crystal structures," Acta Crystallogr D Biol Crystallogr, 2011. 67(Pt 4): p. 355-67.
Ott et al., "Combination immunotherapy: a road map," J Immunother Cancer (2017) 5:16.
Peach et al., "Complementarity determining region 1 (CDR1)- and CDR3-analogous regions in CTLA-4 and CD28 determine the binding to B7-1," J Exp Med (1994) 180(6):2049-2058.
Scarpa et al., "CD80 down-regulation is associated to aberrant DNA methylation in non-inflammatory colon carcinogenesis," BMC Cancer (2016):388.
Schwartz et al., "Structural mechanisms of costimulation," Nat Immunol (2002) 3(5):427-434.
Srivastava et al., "Engineering CAR-T cells: Design Concepts," Trends in Immunology (2015) 36(8):494-502.
Stebbings et al., "After TGN1412: recent developments in cytokine release assays," J Immunotoxicol (2013) 10(1):75-82.
Sutharalingam et al., "Cytokine storm in a phase 1 trial of the anti-CD28 monoclonal antibody TGN1412," N Engl J Med (2006) 355(10):1018-1028.
Vag in et al., "Molecular replacement with MOLREP," Acta Crystallographica Section D (2010) 66(1):22-25.
Vessillier et al., "Cytokine release assays for the prediction of therapeutic mAb safety in first-in man trials—Whole blood cytokine release assays are poorly predictive for TGN1412 cytokine storm," J Immunol Methods (2015) 424:43-52.

(56) References Cited

OTHER PUBLICATIONS

Wei et al., "Distinct Cellular Mechanisms Underlie Anti-CTLA-4 and Anti-PD-1 Checkpoint Blockade," Cell (2017) 170(6):1120-1133.
Winn et al., "Overview of the CCP4 suite and current developments," Acta Crystallogr D Biol Crystallogr (2011) 67(Pt 4):235-242.
Wolchok et al., "Overall Survival with Combined Nivolumab and Ipilimumab in Advanced Melanoma," N Engl J Med (2017) 377(14):1345-1356.
Zak et al., "Structure of the Complex of Human Programmed Death 1, PD-1, and Its Ligand PD-L1," Structure (2015) 23(12):2341-2348.
Zhang et al., "An NKp30-Based Chimeric Anitgen Receptor Promotes T Cell Effector. Functions and Antitumor Efficacy In Vivo," J Immunol (2012) 189:2290-2299.
Zhang et al., "Structural basis of a novel PD-L1 nanobody for immune checkpoint. blockade," Cell Discov (2017) 3:17004.

TIP

CD80 VARIANT IMMUNOMODULATORY PROTEINS AND USES THEREOF

CROSS-REFERENCE TO RELATED APPLICATIONS

This application is a U.S. National Phase Application of International Application No. PCT/US2017/027817, filed Apr. 14, 2017, which claims priority from U.S. provisional application No. 62/323,595 filed Apr. 15, 2016, entitled "CD80 Variant Immunomodulatory Proteins and Uses Thereof," U.S. provisional application No. 62/394,743 filed Sep. 14, 2016, entitled "CD80 Variant Immunomodulatory Proteins and Uses Thereof," U.S. provisional application No. 62/410,844 filed Oct. 20, 2016, entitled "CD80 Variant Immunomodulatory Proteins and Uses Thereof," U.S. provisional application No. 62/472,570 filed Mar. 16, 2017, entitled "CD80 Variant Immunomodulatory Proteins and Uses Thereof," and U.S. provisional application No. 62/475,201 filed Mar. 22, 2017, entitled "CD80 Variant Immunomodulatory Proteins and Uses Thereof," the contents of each of which are incorporated by reference in their entirety.

INCORPORATION BY REFERENCE OF SEQUENCE LISTING

The present application is being filed along with a Sequence Listing in electronic format. The Sequence Listing is provided as a file entitled 761612000400SeqList.txt, created Sep. 26, 2018 which is 816,038 bytes in size. The information in the electronic format of the Sequence Listing is incorporated by reference in its entirety.

FIELD

The present disclosure relates to therapeutic compositions for modulating immune response in the treatment of cancer and immunological diseases. In some aspects, the present disclosure relates to particular variants of CD80 that exhibit altered affinity for a cognate binding partner.

BACKGROUND

Modulation of the immune response by intervening in the processes that occur in the immunological synapse (IS) formed by and between antigen-presenting cells (APCs) or target cells and lymphocytes is of increasing medical interest. Mechanistically, cell surface proteins in the IS can involve the coordinated and often simultaneous interaction of multiple protein targets with a single protein to which they bind. IS interactions occur in close association with the junction of two cells, and a single protein in this structure can interact with both a protein on the same cell (cis) as well as a protein on the associated cell (trans), likely at the same time. Although therapeutics are known that can modulate the IS, improved therapeutics are needed. Provided are immunomodulatory proteins, including soluble proteins or transmembrane immunomodulatory proteins capable of being expressed on cells, that meet such needs.

SUMMARY

In some embodiments, provided herein is a variant CD80 polypeptide containing an IgV domain or a specific binding fragment thereof, an IgC domain or a specific binding fragment thereof, or both, wherein the variant CD80 polypeptide containing one or more amino acid modifications in an unmodified CD80 or specific binding fragment thereof, corresponding to position(s) 4, 9, 10, 11, 12, 13, 14, 15, 16, 17, 18, 20, 21, 22, 24, 25, 27, 28, 29, 30, 31, 33, 36, 37, 38, 40, 41, 42, 43, 44, 47, 48, 50, 52, 53, 54, 59, 60, 61, 62, 63, 64, 65, 66, 67, 68, 69, 70, 72, 74, 76, 77, 80, 81, 83, 85, 86, 87, 88, 89, 90, 91, 92, 93, 94, 95, 96, 97, 99, 102, 103, 104, 108, 107,109, 110, 114, 115, 116, 117, 118, 120, 121, 122, 126, 127, 128, 129, 130, 133, 137, 140, 142, 143, 144, 148, 149, 152, 154, 160, 162, 164, 168, 169, 174, 175, 177, 178, 183, 178, 185, 188, 190, 192, 193, or 199 with reference to numbering of SEQ ID NO: 28. In some embodiments, the one or more amino acid modifications includes one or more amino acid substitution, insertion or deletion. In some embodiments, the unmodified CD80 is a mammalian CD80 or a specific binding fragment thereof. In some embodiments, the unmodified CD80 is a human CD80 or a specific binding fragment thereof. In some embodiments, the variant CD80 polypeptide includes: the IgV domain or a specific binding fragment thereof; and the IgC domain or a specific binding fragment thereof. In some embodiments, the unmodified CD80 includes (i) the sequence of amino acids set forth in SEQ ID NO:28, (ii) a sequence of amino acids that has at least 95% sequence identity to SEQ ID NO:28; or (iii) is a portion thereof comprising an IgV domain or IgC domain or specific binding fragments thereof.

In some embodiments of any one of the variant CD80 polypeptides, the specific binding fragment of the IgV domain or the IgC domain has a length of at least 50, 60, 70, 80, 90, 100, 110 or more amino acids; the specific binding fragment of the IgV domain includes a length that is at least 80% of the length of the IgV domain set forth as amino acids 35-135 of SEQ ID NO: 1; or the specific binding fragment of the IgC domain includes a length that is at least 80% of the length of the IgC domain set forth as amino acids 145-230 of SEQ ID NO: 1. In some embodiments, the variant CD80 polypeptide contains up to 1, 2, 3, 4, 5, 6, 7, 8, 9, 10, 11, 12, 13, 14, 15, 16, 17, 18, 19 or 20 amino acid modifications, optionally amino acid substitutions. In some embodiments, the variant CD80 polypeptide includes a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 28, or a specific binding fragment thereof. In some embodiments, the variant CD80 exhibits altered binding specificity to the ectodomain of CD28, PD-L1, or CTLA-4 compared to the unmodified CD80. In some instances, the altered binding is altfered binding affinity and/or altered binding selectivity.

In some embodiments of any one of the variant CD80 polypeptides, the one or more amino acid substitution is V4M, K9E, E10R, V11S, A12G, A12T, A12V, T13N, L14A, S15V, S15F, C16S, C16G, C16L, G17W, H18L, H18R, H18Y, V20L, S21P, V22A, E24G, L25P, Q27R, T28A, T28S, R29C, R29D, R29H, R29V, I30V, Y31F, Y31H, Y31L, Q33H, K36E, K36G, K37E, K37Q, M38I, M38L, M38T, M38V, L40M, T41A, T41G, T41D, T41I, M42T, M43I, M43Q, M43R, M43V, S44P, M47T, N48I, N48D, W50G, E52G, Y53C, K54M, F59L, F59S, D60V, I61N, T62S, N63S, N64S, L65H, S66H, I67F, I67T, V68A, V68M, I69T, L70Q, L70P, L70R, L72P, P74L, D76G, E77G, E77K, Y80N, E81A, E81R, E81V, V83A, V83I, L85I, L85R, K86E, Y87N, E88D, E88G, K89E, K89N, K89R, D90K, D90L, D90N, A91E, A91G, A91S, A91T, F92L, F92N, F92P, F92Y, K93I, K93E, K93Q, K93R, K93V, R94G, R94L, R94F, E95K, H96R, L97R, E99G, E99D, L102S, S103L, S103P, V104A, V104L, D107N, F108L, P109S, P109H, T110A, S114T, D115G, F116S, F116L, E117V, E117G, I118V, I118A, I118T, T120S, S121P, N122S, I126L, I126V, I127T, C128Y, C128R, S129L, S129P, T130A, G133D, P137L, S140T, L142S, E143G, N144S, N144D, L148S, N149D, N149S, N152T, T154I, T154A, E160G, E162G, Y164H, S168G, K169E, K169I, K169S, M174T, M174V, T175A, N177S, H178R, L183H, K185E, H188D, H188Q, R190S, N192D, Q193L, T199S, or a conservative amino acid substitution thereof.

In some embodiments, the variant CD80 polypeptide contains an IgV domain or an IgC domain, or a specific binding fragment thereof, comprising one or more amino acid deletions in an unmodified CD80 or specific binding fragment thereof. In some embodiments, the deletion corresponds to position 43 of SEQ ID NO: 28.

In some embodiments, the one or more amino acid substitution is V4M/L70Q/A91G/T120S/T130A, A12T/H18L/M43V/F59L/E77K/P109S/I18T, A12V/S15F/Y31H/T41G/T130A/P137L/N152T, V20L/L70Q/A91S/T120S/T130A, V22A/L70Q/S121P, E24G/L25P/L70Q/T120S, T28S/L70Q/A91G/E95K/T120S/T130A, E24G/R29D/Y31L/Q33H/K36G/M38I/T41A/M43R/M47T/F59L/E81V/L85R/K89N/A91T/F92P/K93V/R94L/H96R, R29D/Y31L/Q33H/K36G/M38I/T41A/M42T/M43R/M47T/E81V/L85R/K89N/A91T/F92P/K93V/R94L/L148S/N149S, R29D/Y31L/Q33H/K36G/M38I/T41A/M43R/M47T/E81V/L85R/K89N/A91T/F92P/K93V/R94L/N149S, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144S/N149S, R29H/Y31H/T41G/Y87N/E88G/K89E/D90N/A91G/P109S, R29H/E52G/L70R/E88G/A91G/T130A, R29H/E52G/T120S/T130A, R29V/Y31F/K36G/M38L/M43Q/E81R/V83I/L85I/K89R/D90L/A91E/F92N/K93Q/R94G, R29V/M43Q/E81R/L85I/K89R/D90L/A91E/F92N/K93Q/R94G, Y31H/T41G/L70Q/A91G/T120S/T130A, K36G, K36G/K37Q/M38I/L40M, K36G/K37Q/M38I/F59L/E81V/L85R/K89N/A91T/F92P/K93V/R94L/E99G/T130A/N149S, K36E/I67T/L70Q/A91G/T120S/T130A/N152T, K37E/F59S/L70Q/A91G/T120S/T130A, M38T/L70Q/E77G/A91G/T120S/T130A/N152T, M38V/T41D/M43I/W50G/D76G/V83A/K89E/T120S/T130A, T41I/A91G, S44P/L70Q/A91G/T130A, E52G/L70Q/A91G/T120S/T130A, K54M/A91G/T120S, D60V/A91G/T120S/T130A, N63S/L70Q/A91G/T120S/T130A, S66H/D90G/T110A/F116L, I67F/L70R/E88G/A91G/T120S/T130A, I67T/L70Q/A91G/T120S, V68A/T110A, V68M/L70P/L72P/K86E, L70Q/A91G/T110A/T120S/T130A, L70Q/E81A/A91G/T120S/I127T/T130A, L70Q/Y87N/A91G/T130A, L70Q/A91G, L70Q/A91G/E117G/T120S/T130A, L70Q/A91G/T120S/T130A, L70Q/A91G/T130A, L70Q/A91G/I118A/T20S/T130A, L70R/A91G/T120S/T130A, E88D/K89R/D90K/A91G/F92Y/K93R, K89E/T130A, K89R/D90K/A91G/F92Y/K93R, E88D/K89R/D90K/A91G/F92Y/K93R/N122S/N177S, K89R/D90K/A91G/F92Y/K93R/N122S/N177S, A91G, A91G/F92L/F108L/T120S, A91G/L102S, A91G/S103P, A91G/T120S/T130A, R29D/Y31L/Q33H/K36G/M38I/T41A/M43R/M47T/E81V/L85R/K89N/A91T/F92P/K93V/R94L/T120S/I127T/T130A/K169E, R29D/Y31L/Q33H/K36G/M38I/T41A/M43R/M47T/L70Q/E81V/L85R/K89N/A91T/F92P/K93 V/R94L/T120S/I127T/T130A, H18L/R29D/Y31L/Q33H/K36G/M38I/T41A/M43R/M47T/E81V/L85R/K89N/A91T/F92P/K93V/R94L/T120S/I127T/T130A/K169E, R29D/Y31L/Q33H/K36G/M38I/T41A/M43R/M47T/E81V/L85R/K89N/A91T/F92P/K93V/R94L/T120S/T130A/M174T, R29D/Y31L/Q33H/K36G/M38I/T41A/M43R/M47T/F59L/E81V/L85R/K89N/A91T/F92P/K93V/R94L/T120S/I127T/T130A/H188D, H18R/R29D/Y31L/Q33H/K36G/K37E/M38I/T41A/M43R/M47T/L70Q/E81V/L85R/K89N/A91T/F92P/K93V/R94L/T120S/T130A/K169E/H188D, R29D/Y31L/Q33H/K36G/M38I/T41A/M43R/M47T/L70Q/E81V/L85R/K89N/A91T/F92P/K93V/R94L/T120S/I127T/T130A/E143G/K169E/M174V/H188D, R29D/Y31L/Q33H/K36G/M38I/T41A/M43R/M47T/L70Q/E81V/L85R/K89N/A91T/F92P/K93V/R94L/T120S/I127T/T130A, R29D/Y31L/Q33H/K36G/M38I/T41A/M43R/M47T/E81V/L85R/K89N/A91T/F92P/K93V/R94L/T120S/I127T/T130A/H188D, R29D/Y31L/Q33H/K36G/M38I/T41A/M43R/M47T/L70Q/E81V/L85R/K89N/A91T/F92P/K93V/R94L/T120S/I127T/T130A/K169E, R29D/Y31L/Q33H/K36G/M38I/T41A/M43R/M47T/L70Q/E81V/L85R/K89N/A91T/F92P/K93V/R94L/T120S/I127T/T130A, R29D/Y31L/Q33H/K36G/M38I/T41A/M43R/M47T/L85R/K89N/A91T/F92P/K93V/R94L/T120S/I127T/T130A/K169E/H188D, R29D/Y31L/Q33H/K36G/M38I/T41A/M43R/M47T/E81V/L85R/K89N/A91T/F92P/K93V/R94L/F108L/T120S/T130A/K169E/H188D, R29D/Y31L/Q33H/K36G/M38I/T41A/M43R/M47T/L70Q/E81V/L85R/K89N/A91T/F92P/K93V/R94L/T130A/H188D, R29D/Y31L/Q33H/K36G/M38I/T41A/M43R/M47T/L70Q/E81V/L85R/K89N/A91T/F92P/K93V/R94L/T120S/I127T/T130A/K169E, H18L/R29D/Y31L/Q33H/K36G/M38I/T41A/M43R/M47T/L70Q/E81V/L85R/K89N/A91T/F92P/K93V/R94L/T120S/T130A/K169E/H188D, R29D/Y31L/Q33H/K36G/M38I/T41A/M43R/M47T/E81V/L85R/K89N/A91T/F92P/K93V/R94L/T120S/I127T/C128Y/T130A/H188D, R29D/Y31L/Q33H/K36G/M38I/T41A/M43R/M47T/E81V/L85R/K89N/A91T/F92P/K93V/R94 F/T130A/K169E, H18L/R29D/Y31L/Q33H/K36G/M38I/T41A/M43R/M47T/E81V/L85R/K89N/A91T/F92P/K93V/R94L/T130A, H18L/R29D/Y31L/Q33H/K36G/M38I/T41A/M43R/M47T/L70Q/E81V/L85R/K89N/A91T/F92P/K93V/R94L/T120S/T130A/K169E, R29D/Y31L/Q33H/K36G/M38I/T41A/M43R/M47T/L70Q/E81V/L85R/K89N/A91T/F92P/K93I/R94L/L97R/T130A, R29D/Y31L/Q33H/K36G/M38I/T41A/M43R/M47T/L70Q/E81V/L85R/K89N/A91T/F92P/K93I/R94L/L97R/T130A/L148S, H18L/R29D/Y31L/Q33H/K36G/M38I/T41A/M43R/M47T/E81V/L85R/K89N/A91T/F92P/K93V/R94L/I118V/T120S/I127T/T130A/K169E, R29D/Y31L/Q33H/K36G/M38I/T41A/M43R/M47T/I61N/E81V/L85R/K89N/A91T/F92P/K93V/R94F/V104A/T120S/T130A, R29D/Y31L/Q33H/K36G/M38I/T41A/M43R/M47T/E81V/L85R/K89N/F92P/K93V/R94F/I118V/T130A, R29D/Y31L/Q33H/K36G/M38I/T41A/M43R/M47T/T62S/E81V/L85R/K89N/A91T/F92P/K93V/R94L/I118V/T120S/T130A/K169E/T175A, H18L/R29D/Y31L/Q33H/K36G/M38I/T41A/M43R/M47T/E81V/L85R/K89N/A91T/F92P/K93V/R94L/F116S/T130A/H188D, H18L/R29D/Y31L/Q33H/K36G/M38I/T41A/M43R/M47T/E81V/L85R/K89N/A91T/F92P/K93V/R94L/T120S/I127T/T130A/L142S/H188D, C16S/H18L/R29D/Y31L/Q33H/K36G/M38I/T41A/M43R/M47T/E81V/L85R/K89N/A91T/F92P/K93V/R94L/T110A/H188D, R29D/Y31L/Q33H/K36G/M38I/T41A/M43R/M47T/A91G/T120S/I127T/T130A/H188D, R29D/Y31L/Q33H/K36G/M38I/T41A/M43R/M47T/L70Q/D76G/A91G/S103L/T120S/I127T/T 130A, Q33 deleted/Y53C/L85R/K89N/A91T/F92P/K93V/R94L/T120S/I127T/T130A/K169E, T62S/E81V/L85R/K89N/A91T/F92P/K93V/R94L/T120S/T130A/K169E, R29D/Y31L/Q33H/K36G/M38I/T41A/M43R/M47T/E81V/L85R/K89N/A91T/F92P/K93V/R94L/S129L/H188D, K9E/E10R/V11S/A12G/T13N/K14A/S15V/C16L/G17W/H18Y/Y53C/L70Q/D90G/T130A/N149D/N152T/H188D, H18L/R29D/Y31L/

Q33H/K36G/T41A/M43R/M47T/E81V/L85R/K89N/A91T/F92P/K93V/R94L/I118V/T120S/I127T/T130A/H188D, K89E/K93E/T130A, S21P/R29D/Y31L/Q33H/K36G/M38I/T41A/M43R/M47T/N48I/V68A/E81V/L85R/K89N/A91T/F92P/K93V/R94L/P109H/I26L/K169I, H18L/R29D/Y31L/Q33H/K36G/M38I/T41A/M43R/M47T/P74L/Y80N/E81V/L85R/K89N/A91T/F92P/K93V/R94L/L97R, S21P/R29D/Y31L/Q33H/K36G/M38I/T41A/M43R/M47T/P74L/Y80N/E81V/L85R/K89N/D90N/A91T/F92P/K93V/R94L/T130A/N149S/E162G, H18L/R29D/Y31L/Q33H/K36G/M38I/T41A/M43R/M47T/V68M/E81V/L85R/K89N/A91T/F92P/K93V/R94L/T130A, R29D/Y31L/Q33H/K36G/M38I/T41A/M43R/M47T/V68M/E81V/L85R/K89N/A91T/F92P/K93V/R94L/T130A/N149S/R190S, H18L/R29D/Y31L/Q33H/K36G/M38I/T41A/M43R/M47T/P74L/Y80N/E81V/L85R/K89N/A91T/F92P/K93V/R94L/T130A/R190S, C16G/V22A/R29D/Y31L/Q33H/K36G/M38I/T41A/M43R/M47T/V68M/D76G/E81V/L85R/K89N/A91T/F92P/K93V/R94L/I18T/T130A/S140T/N149S/K169I/H178R/N192D, R29D/Y31L/Q33H/K36G/M38I/T41A/M43R/M47T/E81V/L85R/K89N/A91T/F92P/K93V/R94F/E117V/I118T/N149S/S168G/H188Q, V22A/R29D/Y31L/Q33H/K36G/M38I/T41A/M43R/M47T/V68M/E81V/L85R/K89N/A91T/F92P/K93V/R94L/T130A, R29D/Y31L/Q33H/K36G/M38I/T41A/M43R/M47T/N64S/E81V/L85R/K89N/A91T/F92P/K93V/R94F/I118T/T130A/N149S/K169I, V22A/R29D/Y31L/Q33H/K36G/M38I/T41A/M43R/M47T/V68M/E81V/L85R/K89N/A91T/F92P/K93V/R94L/D115G/I118T/T130A/G133D/N149S, S129P, A91G/S129P, I69T/L70Q/A91G/T120S, Y31H/S129P, T28A/R29D/Y31L/Q33H/K36G/M38I/T41A/M43R/M47T/E81V/L85R/K89N/A91T/F92P/K93V/R94L/V104L/T130A/N149S, H18L/R29D/Y31L/Q33H/K36G/M38I/T41A/M43R/M47T/E81V/L85R/K89N/A91T/F92P/K93V/R94L/L97R/N149S/H188Q, H18L/R29D/Y31L/Q33H/K36G/M38I/T41A/M43R/M47T/E81V/L85R/K89N/A91T/F92P/K93V/R94L/L97R/N149S, H18L/R29D/Y31L/Q33H/K36G/M38I/T41A/M43R/M47T/V68A/E81V/L85R/K89N/A91T/F92P/K93V/R94L/T130A/N149S/T154I, A12G/R29D/Y31L/Q33H/K36G/M38I/T41A/M43R/M47T/V68A/E81V/L85R/K89N/A91T/F92 P/K93V/R94L/L97R/T130A/L183H, R29D/Y31L/Q33H/K36G/M38I/T41A/M43R/M47T/E81V/L85R/K89N/A91T/F92P/K93V/R94L/I118T/T130A/S140T/N149S/K169S, R29D/Y31L/Q33H/K36G/M38I/T41A/M43R/M47T/E81V/L85R/K89N/A91T/F92P/K93V/R94L/I118T/T130A/N149S/K169I/Q193L, V22A/R29D/Y31L/Q33H/K36G/M38I/T41A/M43R/M47T/E81V/L85R/K89N/A91T/F92P/K93V/R94L/I118T/T130A/N149S, R29D/Y31L/Q33H/K36G/M38I/T41A/M43R/M47T/E81V/L85R/K89N/A91T/F92P/K93V/R94L/I118T/T130A/N149S, R29D/Y31L/Q33H/K36G/M38I/T41A/M43R/M47T/E81V/L85R/K89N/A91T/F92P/K93V/R94L/I118T/T130A/N149S/K169I, R29D/Y31L/Q33H/K36G/M38I/T41A/M43R/M47T/E81V/L85R/K89N/A91T/F92P/K93V/R94F/T130A/N149S/K169I, I118T/C128R, Q27R/R29C/M42T/S129P/E160G, S129P/T154A, S21P/L70Q/D90G/T120S/T130A, L70Q/A91G/N144D, L70Q/A91G/I118A/T120S/T130A/K169E, V4M/L70Q/A91G/I118V/T120S/T130A/K169E, L70Q/A91G/I118V/T120S/T130A/K169E, L70Q/A91G/I118V/T120S/T130A, V20L/L70Q/A91S/I118V/T120S/T130A, L70Q/A91G/E117G/I118V/T120S/T130A, A91G/I118V/T120S/T130A, L70R/A91G/I118V/T120S/T130A/T199S, L70Q/E81A/A91G/I118V/T120S/I127T/T130A, T28S/L70Q/A91G/E95K/I118V/T120S/I126V/T130A/K169E, N63S/L70Q/A91G/S114T/I118V/T120S/T130A, K36E/I67T/L70Q/A91G/I118V/T120S/T130A/N152T, E52G/L70Q/A91G/D107N/I118V/T120S/T130A/K169E, K37E/F59S/L70Q/A91G/I118V/T120S/T130A/K185E, D60V/A91G/I118V/T120S/T130AK169E, K54M/L70Q/A91G/Y164H/T120S, M38T/L70Q/E77G/A91G/I118V/T120S/T130A/N152T, Y31H/T41G/M43L/L70Q/A91G/I118V/T120S/I126V/T130A, L65H/D90G/T110A/F116L, R29H/E52G/D90N/I118V/T120S/T130A, I67T/L70Q/A91G/I118V/T120S, L70Q/A91G/T110A/I118V/T120S/T130A, M38V/T41D/M43I/W50G/D76G/V83A/K89E/I118V/T120S/I126V/T130A, A12V/S15F/Y31H/M38L/T41 G/M43L/D90N/T130A/P137L/N149D/N152T, I67F/L70R/E88G/A91G/I118V/T120S/T130A, E24G/L25P/L70Q/A91G/I118V/T120S/N152T, A91G/F92L/F108L/I118V/T120S, E88D/K89R/D90K/A91G/F92Y/K93R/N122S/N177S, K36G/K37Q/M38I/L40M/F59L/E81V/L85R/K89N/A91T/F92P/K93V/R94L/E99G/T130A/N149S, K36G/L40M, R29D/Y31L/Q33H/K36G/M38I/T41A/M43R/M47T/E81V/L85R/K89N/A91T/F92P/K93V/R94L/I118V/T120S/I127T/T130A/K169E, R29D/Y31L/Q33H/K36G/M38I/T41A/M43R/M47T/L70Q/E81V/L85R/K89N/A91T/F92P/K93V/R94L/I118V/T120S/I127T/T130A, H18L/R29D/Y31L/Q33H/K36G/M38I/T41A/M43R/M47T/E81V/L85R/K89N/A91T/F92P/K93V/R94L/I118V/T120S/I127T/T130A/K169E, R29D/Y31L/Q33H/K36G/M38I/T41A/M43R/M47T/E81V/L85R/K89N/A91T/F92P/K93V/R94L/I118V/T120S/T130A/K169E/M174T, R29D/Y31L/Q33H/K36G/M38I/T41A/M43R/M47T/N48D/F59L/E81V/L85R/K89N/A91T/F92P/K93V/R94L/I118V/T120S/I127T/T130A/H188D, H18R/R29D/Y31L/Q33H/K36G/K37E/M38I/T41A/M43R/M47T/L70Q/E81V/L85R/K89N/A91T/F92P/K93V/R94L/I118V/T120S/T130A/K169E/H188D, R29D/Y31L/Q33H/K36G/M38I/T41A/M43R/M47T/L70Q/E81V/L85R/K89N/A91T/F92P/K93V/R94L/I118V/T120S/I127T/T130A/E143G/K169E/M174V/H188D, R29D/I30V/Y31L/Q33H/K36G/M38I/T41A/M43R/M47T/E81V/L85R/K89N/A91T/F92P/K93V/R94L/I118V/T120S/I127T/T130A/H188D, R29D/Y31L/Q33H/K36G/M38I/T41A/M43R/M47T/E81V/L85R/K89N/A91T/F92P/K93V/R94L/I118V/T120S/I127T/T130A/H188D, R29D/Y31L/Q33H/K36G/M38I/T41A/M43R/M47T/L70Q/E81V/L85R/K89N/A91T/F92P/K93V/R94L/I118V/T120S/I127T/T130A/K169E, R29D/Y31L/Q33H/K36G/M38I/T41A/M43R/M47T/L70Q/E81V/K89N/A91T/F92P/K93V/R94L/I118V/T120S/I127T/T130A, R29D/Y31L/Q33H/K36G/M38I/T41A/M43R/M47T/L85R/K89N/A91T/F92P/K93V/R94L/I118V/T120S/I127T/T130A/K169E/H188D, R29D/Y31L/Q33H/K36G/M38I/T41A/M43R/M47T/E81V/L85R/K89N/A91T/F92P/K93V/R94L/F108L/I118V/T120S/T130A/K169E/H188D, R29D/Y31L/Q33H/K36G/M38I/T41A/M43R/M47T/L70Q/E81V/L85R/K89N/A91T/F92P/K93V/R94L/I118V/T120S/T130A/N149D/K169E/H188D, H18L/R29D/Y31L/Q33H/K36G/M38I/T41A/M43R/M47T/L70Q/E81V/L85R/K89N/A91T/F92 P/K93V/R94L/I118V/T120S/T130A/K169E/H188D, R29D/Y31L/Q33H/K36G/M38I/T41A/M43R/M47T/E81V/L85R/K89N/A91T/F92P/K93V/R94L/I118V/T120S/I127T/C128Y/T130A/H188D, H18L/R29D/Y31L/Q33H/K36G/M38I/T41A/M43R/M47T/E81V/L85R/K89N/A91T/F92P/K93V/R94L/E99D/T130A, H18L/R29D/Y31L/Q33H/K36G/M38I/T41A/M43R/M47T/L70Q/E81V/L85R/K89N/A91T/F92P/K93V/R94L/I118V/T120S/T130A/K169E, R29D/Y31L/Q33H/K36G/M38I/T41A/M43R/M47T/I61N/E81V/L85R/K89N/A91T/F92P/K93V/R94F/V104A/I118V/T120S/I126V/T130A, R29D/Y31L/Q33H/K36G/M38I/T41A/M43R/M47T/E81V/L85R/K89N/A91T/F92P/K93V/R94F/I118V/T120S/T130A, H18L/R29D/Y31L/Q33H/K36G/M38I/T41A/

M43R/M47T/E81V/L85R/K89N/A91T/F92P/K93V/R94L/I118V/T120S/I127T/T130A/L142S/H188D, C16S/H18L/R29D/Y31L/Q33H/K36G/M38I/T41A/M43R/M47T/E81V/L85R/K89N/A91T/F92P/K93V/R94L/T110A/I118V/H188D, R29D/Y31L/Q33H/K36G/M38I/T41A/M43R/M47T/A91G/I118V/T120S/I127T/T130A/H188D, R29D/Y31L/Q33H/K36G/M38I/T41A/M43R/M47T/L70Q/D76G/A91G/S103L/I118V/T120S/I127T/T130A, Y53C/L85R/K89N/A91T/F92P/K93V/R94L/I118V/T120S/I127T/T130A/K169E, T62S/E81V/L85R/K89N/A91T/F92P/K93V/R94L/I118V/T120S/T130A/K169E, Y53C/L70Q/D90G/T130A/N149D/N152T/H188D, H18L/R29D/Y31L/Q33H/K36G/M38I/T41A/M43R/M47T/E81V/L85R/K89N/A91T/F92P/K93V/R94L/I118V/T120S/I127T/T130A/H188D, or H18L/R29D/Y31L/Q33H/K36G/M38I/T41A/M43R/M47T/E81V/L85R/K89N/A91T/F92P/K93V/R94L/T130A/N149S.

In some embodiments of any one of the variant CD80 polypeptides, the variant CD80 polypeptide contains the IgV domain or a specific fragment thereof and/or the IgC domain or a specific fragment thereof. In some embodiments of any one of the variant CD80 polypeptides, the variant CD80 polypeptide contains the IgV domain or a specific binding fragment thereof. In some embodiments, the IgV domain or specific binding fragment thereof is the only CD80 portion of the variant CD80 polypeptide. In some embodiments, the IgC domain or specific binding fragment thereof is the only CD80 portion of the variant CD80 polypeptide.

In some embodiments of any one of the variant CD80 polypeptides, the variant CD80 polypeptide includes the sequence of amino acids set forth in any of SEQ ID NOS: 55-108, 280-346, 414-475 or a specific binding fragment thereof, or a sequence of amino acids that exhibits at least 85%, 86%, 87%, 88%, 89%, 90%, 91%, 92%, 93%, 94%, 95%, 96%, 97%, 98%, 99% sequence identity to any of SEQ ID NOS: 55-108, 280-346, 414-475 or a specific binding fragment thereof and that contains the one or more of the amino acid substitutions. In some embodiments, the variant CD80 polypeptide includes the IgV domain or a specific binding fragment thereof. In some embodiments, the IgV domain or specific fragment thereof is the only CD80 portion of the variant CD80 polypeptide. In some embodiments, the IgC domain or specific fragment thereof is the only CD80 portion of the variant CD80 polypeptide. In some embodiments of any one of the variant CD80 polypeptides, the variant CD80 polypeptide includes the sequence of amino acids set forth in any of SEQ ID NOS: 153-195, 347, 373-386, 476-477 or a specific binding fragment thereof, a sequence of amino acids that exhibits at least 85%, 86%, 87%, 88%, 89%, 90%, 91%, 92%, 93%, 94%, 95%, 96%, 97%, 98%, 99% sequence identity to any of SEQ ID NOS: 153-195, 347, 373-386, 476-477 or a specific binding fragment thereof and that contains the one or more of the amino acid substitutions.

In some embodiments of any one of the variant CD80 polypeptides, the variant CD80 polypeptide specifically binds to the ectodomain of CD28, PD-L1, or CTLA-4 with increased affinity compared to the unmodified CD80 polypeptide. In some of any such embodiments, the variant polypeptide specifically binds to the ectodomain of CD28, PD-L1 or CTLA-4 with increased selectivity compared to the binding of the unmodified CD80 for the ectodomain. In some aspects, the increased selectivity includes a greater ratio for one cognate binding partner selected from among CD28, PD-L1 and CTLA-4 versus another of the cognate binding partner compared to the ratio of binding of the unmodified CD80 polypeptide for the one cognate binding partner versus the another of the cognate binding partner.

In some embodiments, the variant polypeptide specifically binds to the ectodomain of CD28 with increased selectivity compared to the binding of the unmodified CD80 for the ectodomain of CD28. In some aspects, the increased selectivity includes a greater ratio for binding CD28 versus PD-L1 or CTLA-4 compared to the ratio of binding of the unmodified CD80 polypeptide for CD28 versus PD-L1 or CTLA-4. In some cases, the ratio is greater by at least or at least about 1.5-fold, 2.0-fold, 3.0-fold, 4.0-fold. 5-fold, 10-fold, 15-fold, 20-fold, 30-fold, 40-fold, 50-fold or more.

In some embodiments, the variant CD80 polypeptide specifically binds to the ectodomain of CD28 with increased affinity compared to the unmodified CD80 polypeptide. In some embodiments, the increased affinity to the ectodomain is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to the binding affinity of the unmodified CD80 for the ectodomain.

In some embodiments of any one of the variant CD80 polypeptides, the one or more amino acid substitutions corresponds to position(s) 12, 18, 20, 29, 31, 36, 40, 41, 43, 52, 59, 60, 63, 67, 70, 77, 81, 87, 88, 89, 90, 91, 92, 93, 107, 109, 114, 117, 118, 120, 122, 127, 130, 144, 169, 177 or 199 with reference to numbering of SEQ ID NO: 28. In some embodiments, the one or more amino acid substitution is selected from the group consisting of A12T, H18L, V20L, R29H, Y31H, K36G, L40M, T41G, T41I, M43V, E52G, F59L, D60V, N63S, I67T, L70Q, L70R, E77K, E81A, Y87N, E88D, E88G, K89E, K89R, D90K, D90N, A91G, A91S, F92Y, K93R, D107N, P109S, S114T, E117G, I118A, I118T, I118V, T120S, I127T, T130A, N144D, K169E, N177S and T199S and conservative amino acid substitutions thereof. In some embodiments, the one or more amino acid substitution is A12T/H18L/M43V/F59L/E77K/P109S/I118T, V20L/L70Q/A91S/T120S/T130A, V20L/L70Q/A91S/I118V/T120S/T130A, R29H/Y31H/T41G/Y87N/E88G/K89E/D90N/A91G/P109S, K36G, K36G/L40M, T41I/A91G, E52G/L70/A91G/T120S/T130A, E52G/L70Q/A91G/D107N/I118V/T120S/T130A/K169E, D60V/A91G/T120S/T130A, D60V/A91G/I118V/T120S/T130A/K169E, N63S/L70Q/A91G/T120S/T130A, N63S/L70Q/A91G/S114T/I118V/T120S/T130A, I67T/L70Q/A91G/T120S, I67T/L70Q/A91G/I118V/T120S, L70Q/E81A/A91G/T120S/I127T/T130A, L70Q/E81A/A91G/I118V/T120S/I127T/T130A, L70Q/Y87N/A91G/T130A, L70Q/A91G, L70Q/A91G/N144D, L70Q/A91G/E117G/T120S/T130A, L70Q/A91G/E117G/I118V/T120S/T130A, L70Q/A91G/I118A/T120S/T130A, L70Q/A91G/I118A/T120S/T130A/K169E, L70Q/A91G/T120S/T13A, L70Q/A91G/I118V/T120S/T13A/K169E, L70R/A91G/T120S/T130A, L70R/A91G/I118V/T120S/T130A/T199S, E88D/K89R/D90K/A91G/F92Y/K93R, K89R/D90K/A91G/F92Y/K93R, or K89R/D90K/A91G/F92Y/K93R/N122S/N177S.

In some embodiments of any one of the variant CD80 polypeptides, the variant CD80 polypeptide specifically binds to the ectodomain of PD-L1 with increased affinity compared to the unmodified CD80 polypeptide. In some cases, the increased affinity to the ectodomain is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to the binding affinity of the unmodified CD80 for the ectodomain. In some of any such embodiments, the variant polypeptide specifically binds to the ectodomain of PD-L1 with increased selectivity compared to the binding of the unmodified CD80 for the ectodomain. In some cases, the increased selectivity includes a greater ratio for binding PD-L1 versus CD28 or CTLA-4 compared to the ratio of binding of the unmodified CD80 polypeptide for PD-L1 versus CD28 or CTLA-4. In some instances, the ratio is greater by at least or at least about 1.5-fold, 2.0-fold, 3.0-fold, 4.0-fold. 5-fold, 10-fold, 15-fold, 20-fold, 30-fold, 40-fold, 50-fold or more.

In some embodiments, the one or more amino acid substitutions corresponds to position(s) 12, 18, 29, 31, 33, 36, 38, 40, 41, 42, 43, 47, 59, 67, 70, 77, 81, 85, 87, 88, 89, 90, 91, 92, 93, 94, 109, 118, 120, 122, 144, 148, 149, or 177 with reference to numbering of SEQ ID NO: 28. In some embodiments, the one or more amino acid substitution is selected from the group consisting of A12T, H18L, R29D, R29H, Y31H, Y31L, Q33H, K36G, M38I, L40M, T41A, T41G, M42T, M43R, M43V, M47T, F59L, I67T, L70Q, E77K, E81V, L85R, Y87N, E88D, E88G, K89E, K89N, K89R, D90K, D90N, A91G, A91T, F92P, F92Y, K93R, K93V, R94L, P109S, I118T, I118V, T120S, N122S, N144S, L148S, N149S, and N177S, and conservative amino acid substitutions thereof. In some embodiments, the one or more amino acid substitution is A12T/H18L/M43V/F59L/E77K/P109S/I118T, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144S/N149S, R29D/Y31L/Q33H/K36G/M38I/T41A/M42T/M43R/M47T/E81V/L85R/K89N/A91T/F92P/K93V/R94L/L148S/N149S, R29D/Y31L/Q33H/K36G/M38I/T41A/M43R/M47T/E81V/L85R/K89N/A91T/F92P/K93V/R94L/N149S, R29H/Y31H/T41G/Y87N/E88G/K89E/D90N/A91G/P109S, K36G, K36G/L40M, I67T/L70Q/A91G/T120S, I67T/L70Q/A91G/I118V/T120S, E88D/K89R/D90K/A91G/F92Y/K93R, K89R/D90K/A91G/F92Y/K93R, or A91G.

In some embodiments of any one of the variant CD80 polypeptides, the variant CD80 polypeptide specifically binds to the ectodomain of CD28 and the ectodomain of PD-L1 with increased affinity compared to the unmodified CD80 polypeptide. In some embodiments, the one or more amino acid substitutions corresponds to position(s) 12, 18, 36, 40, 43, 59, 77, 88, 89, 90, 91, 92, 93, 109, 118, 122, 177 with reference to numbering of SEQ ID NO: 28. In some embodiments, the one or more amino acid substitution is selected from the group consisting of A12T, H18L, K36G, L40M, M43V, F59L, E77K, E88D, K89R, D90K, A91G, F92Y, K93R, P109S, I118T, N112S, N177S, and conservative amino acid substitutions thereof. In some embodiments, the one or more amino acid substitution is A12T/H18L/M43V/F59L/E77K/P109S/I118T, K36G, K36G/L40M, E88D/K89R/D90K/A91G/F92Y/K93R, K89R/D90K/A91G/F92Y/K93R, or K89R/D90K/A91G/F92Y/K93R/N122S/N177S.

In some embodiments of any one of the variant CD80 polypeptides, the variant CD80 polypeptide specifically binds to the ectodomain of CTLA-4 with increased affinity compared to the unmodified CD80 polypeptide. In some embodiments, the increased affinity to the ectodomain is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to the binding affinity of the unmodified CD80 for the ectodomain. In some of any such embodiments, the variant polypeptide specifically binds to the ectodomain of CTLA-4 with increased selectivity compared to the binding of the unmodified CD80 for the ectodomain. In some cases, the increased selectivity includes a greater ratio for binding CTLA-4 versus CD28 or PD-L1 compared to the ratio of binding of the unmodified CD80 polypeptide for CTLA-4 versus CD28 or PD-L1. In some embodiments, the ratio is greater by at least or at least about 1.5-fold, 2.0-fold, 3.0-fold, 4.0-fold. 5-fold, 10-fold, 15-fold, 20-fold, 30-fold, 40-fold, 50-fold or more.

In some embodiments, the one or more amino acid substitutions corresponds to position(s) 4, 29, 31, 36, 40, 41, 52, 67, 68, 70, 87, 88, 89, 90, 91, 92, 93, 107, 109, 110, 118, 120, 130, 144, or 169 with reference to numbering of SEQ ID NO: 28. In some embodiments, the one or more amino acid substitution is selected from the group consisting of V4M, R29H, Y31H, K36G, L40M, T41G, E52G, I67T, V68A, L70Q, Y87N, E88D, E88G, K89E, K89R, D90K, D90N, A91G, F92Y, K93R, D107N, P109S, T110A, I118V, T120S, T130A, N144D, and K169E and conservative amino acid substitutions thereof. In some embodiments, the one or more amino acid substitution is V4M/L70Q/A91G/T120S/T130A, V4M/L70Q/A91G/I118V/T120S/T130A/K169E, R29H/Y31H/T41G/Y87N/E88G/K89E/D90N/A91G/P109S, K36G, K36G/L40M, E52G/L70Q/A91G/T120S/T130A, E52G/L70Q/A91G/D107N/I118V/T120S/T130A/K169E, I67T/L70Q/A91G/T120S, I67T/L70Q/A91G/I118V/T120S, V68A/T110A, L70Q/A91G, L70Q/A91G/N144D, L70Q/A91G/T120S/T130A, L70Q/A91G/I118V/T120S/T130A/K169E, L70Q/A91G/T130A, K89R/D90K/A91G/F92Y/K93R, E88D/K89R/D90K/A91G/F92Y/K93R, A91G/I118V/T120S/T130A, or A91G/T120S/T130A.

In some embodiments of any one of the variant CD80 polypeptides, the variant CD80 polypeptide specifically binds to the ectodomain of CD28 and the ectodomain of CTLA-4 with increased affinity compared to the unmodified CD80 polypeptide. In some embodiments, the one or more amino acid substitutions correspond(s) to position(s) 36, 40, 52, 70, 88, 89, 90, 91, 92, 93, 107, 118, 120, 130, 144, or 169 of SEQ ID NO: 28. In some embodiments, the one or more amino acid substitution is selected from the group consisting of K36G, L40M, E52G, L70Q, E88D, K89R, D90K, A91G, F92Y, K93R, D107N, I118V, T120S, T130A, N144D, and K169E, and conservative amino acid substitutions thereof. In some embodiments, the one or more amino acid substitution is K36G, K36G/L40M, E52G/L70Q/A91G/T120S/T130A, E52G/L70Q/A91G/D107N/I118V/T120S/T130A/K169E, L70Q/A91G, L70Q/A91G/N144D, L70Q/A91G/T120S/T130A, L70Q/A91G/I118V/T120S/T130A/K169E, E88D/K89R/D90K/A91G/F92Y/K93R, or K89R/D90K/A91G/F92Y/K93R.

In some embodiments of any one of the variant CD80 polypeptides, the variant CD80 polypeptide specifically binds to the ectodomain of PD-L1 and the ectodomain of CTLA-4 with increased affinity compared to the unmodified CD80 polypeptide. In some embodiments, the one or more amino acid substitutions corresponds to position(s) 29, 31, 36, 40, 41, 67, 70, 87, 88, 89, 90, 91, 92, 93, 109, 118, 120, 122, or 178 of SEQ ID NO: 28. In some embodiments, the one or more amino acid substitution is selected from the group consisting of R29H, Y31H, K36G, L40M, T41G, I67T, L70Q, Y87N, E88D, E88G, K89E, K89R, D90N, D90K, A91G, F92Y, K93R, P109S, I118V, T120S, and conservative amino acid substitutions thereof. In some embodiments, the one or more amino acid substitution is R29H/Y31H/T41G/Y87N/E88G/K89E/D90N/A91G/P109S, K36G, K36G/L40M, I67T/L70Q/A91G/T120S, I67T/L70Q/A91G/I118V/T120S, E88D/K89R/D90K/A91G/F92Y/K93R, or K89R/D90K/A91G/F92Y/K93R.

In some embodiments of any one of the variant CD80 polypeptides, the variant CD80 polypeptide specifically binds to the ectodomain of CD28, the ectodomain of PD-L1, and the ectodomain of CTLA-4 with increased affinity compared to the unmodified CD80 polypeptide. In some embodiments, the one or more amino acid substitutions corresponds to position(s) 36, 40, 88, 89, 90, 91, 92, or 93 of SEQ ID NO: 28. In some embodiments, the one or more amino acid substitution is selected from the group consisting of K36G, L40M, E88D, K89R, D90K, A91G, F92Y, K93R, and conservative amino acid substitutions thereof. In some embodiments, the one or more amino acid substitution is K36G, K36G/L40M, E88D/K89R/D90K/A91G/F92Y/K93R, or K89R/D90K/A91G/F92Y/K93R.

In some embodiments of any one of the variant CD80 polypeptides, the variant CD80 polypeptide specifically binds to the ectodomain of CD28 or the ectodomain of PD-L1 with increased affinity compared to the unmodified CD80 polypeptide, and the variant CD80 polypeptide specifically binds to the ectodomain of CTLA-4 with decreased affinity compared to the unmodified CD80 polypeptide. In some embodiments, the one or more amino acid substitutions corresponds to position(s) 29, 31, 33, 36, 38, 41, 42, 43, 47, 63, 67, 70, 81, 85, 87, 88, 89, 90, 91, 92, 93, 94, 109, 114, 118, 120, 127, 130, 144, 148, or 149 of SEQ ID NO: 28. In some embodiments, the one or more amino acid substitution is selected from the group consisting of R29D, R29H, Y31H, Y31L, Q33H, K36G, M38I, T41A, T41G, M42T, M43R, M47T, N63S, I67T, L70Q, E81A, E81V, L85R, Y87N, E88G, K89E, K89N, D90N, A91G, A91T, F92P, K93V, R94L, P109S, S114T, I118T, I118V, T120S, I127T, T130A, N144S, L148S, and N149S, and conservative amino acid substitutions thereof. In some embodiments, the one or more amino acid substitution is N63 S/L70Q/A91G/T120S/T130A, N63S/L70Q/A91G/S14T/I118V/T120S/T130A, or L70Q/Y87N/A91G/T120S/I127T/T130A.

In some embodiments of any one of the variant CD80 polypeptides, the variant CD80 polypeptide specifically binds to the ectodomain of CD28 with increased affinity compared to the unmodified CD80 polypeptide, and the variant CD80 polypeptide specifically binds to the ectodomain of CTLA-4 with decreased affinity compared to the unmodified CD80 polypeptide. In some embodiments, the one or more amino acid substitutions corresponds to position (s) 63, 70, 81, 87, 91, 114, 118, 120, 127, or 130 of SEQ ID NO: 28. In some embodiments, the one or more amino acid substitution is selected from the group consisting of N63S, L70Q, E81A, Y87N, A91G, S114T, I118V, T120S, I127T, and T130A, and conservative amino acid substitutions thereof. In some embodiments, the one or more amino acid substitution is R29D/Y31L/Q33H/K36G/M38I/T41A/M42T/M43R/M47T/E81V/L85R/K89N/A91T/F92P/K93V/R94L/L148S/N149S, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144S/N149S, R29D/Y31L/Q33H/K36G/M38I/T41A/M43R/M47T/E81V/L85R/K89N/A91T/F92P/K93V/R94L/N149S, R29H/Y31H/T41G/Y87N/E88G/K89E/D90N/A91G/P109S, N63S/L70Q/A91G/T120S/T130A, N63S/L70Q/A91G/S114T/I118V/T120S/T130A, I67T/L70Q/A91G/T120S, I67T/L70Q/A91G/I118V/T120S, or L70Q/Y87N/A91G/T120S/I127T/T130A.

In some embodiments of any one of the variant CD80 polypeptides, the variant CD80 polypeptide specifically binds to the ectodomain of PD-L1 with increased affinity compared to the unmodified CD80 polypeptide, and the variant CD80 polypeptide specifically binds to the ectodomain of CTLA-4 with decreased affinity compared to the unmodified CD80 polypeptide. In some embodiments, the one or more amino acid substitutions corresponds to position(s) 29, 31, 33, 36, 38, 41, 42, 43, 47, 67, 70, 81, 85, 87, 88, 89, 90, 91, 92, 93, 94, 109, 118, 120, 144, 148, 149 of SEQ ID NO: 28. In some embodiments, the one or more amino acid substitution is selected from the group consisting of R29D, R29H, Y31H, Y31L, Q33H, K36G, M38I, T41A, T41G, M42T, M43R, M47T, I67T, L70Q, E81V, L85R, Y87N, E88G, K89E, K89N, D90N, A91G, A91T, F92P, K93V, R94L, P109S, I118T, I118V, T120S, N144S, L148S, and N149S, and conservative amino acid substitutions thereof. In some embodiments, the one or more amino acid substitution is R29D/Y31L/Q33H/K36G/M38I/T41A/M42T/M43R/M47T/E81V/L85R/K89N/A91T/F92P/K93V/R94L/L148S/N149S, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144S/N149S, R29D/Y31L/Q33H/K36G/M38I/T41A/M43R/M47T/E81V/L85R/K89N/A91T/F92P/K93V/R94L/N149S, R29H/Y31H/T41G/Y87N/E88G/K89E/D90N/A91G/P109S, I67T/L70Q/A91G/I118V/T120S, or I67T/L70Q/A91G/T120S.

In some embodiments of any one of the variant CD80 polypeptides, the variant CD80 polypeptide specifically binds to the ectodomain of CD28 and the ectodomain of PD-L1 with increased affinity compared to the unmodified CD80 polypeptide, and the variant CD80 polypeptide specifically binds to the ectodomain of CTLA-4 with decreased affinity compared to the unmodified CD80 polypeptide. In some embodiments, the one or more amino acid substitutions correspond(s) to position(s) of 70, 81, 87, 91, or 120 of SEQ ID NO: 28. In some embodiments, the one or more amino acid substitution is selected from the group consisting of L70Q, Y87N, A91G, and T120S, and conservative amino acid substitutions thereof.

In some embodiments of any one of the variant CD80 polypeptides, the CD28 is a human CD28. In some embodiments, the PD-L1 is a human PD-L1. In some embodiments, the CTLA-4 is a human CTLA-4.

In some embodiments of any one of the variant CD80 polypeptides, the binding activity is altered (increased or decreased) more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold compared to the unmodified CD80 polypeptide.

In some embodiments of any one of the variant CD80 polypeptides, the variant CD80 polypeptide is a soluble protein.

In some embodiments of any one of the variant CD80 polypeptides, the variant CD80 polypeptide is linked to a multimerization domain. In some embodiments, the variant CD80 polypeptide is a multimeric polypeptide, optionally a dimeric polypeptide, comprising a first variant CD80 polypeptide linked to a multimerization domain and a second variant CD80 polypeptide linked to a multimerization domain. In some embodiments, the first variant CD80 polypeptide and the second variant CD80 polypeptide are the same or different. In some embodiments, the multimerization domain is an Fc domain or a variant thereof with reduced effector function.

In some embodiments of any one of the variant CD80 polypeptides, the variant CD80 polypeptide is linked to a moiety that increases biological half-life of the polypeptide. In some embodiments, the variant CD80 polypeptide is linked to an Fc domain or a variant thereof with reduced effector function. In some embodiments, the Fc domain is mammalian, optionally human; or the variant Fc domain contains one or more amino acid modifications compared to an unmodified Fc domain that is mammalian, optionally human. In some embodiments, the Fc domain or variant thereof contains the sequence of amino acids set forth in SEQ ID NO:226 or SEQ ID NO:227 or a sequence of amino acids that exhibits at least 85%, 86%, 87%, 88%, 89%, 90%, 91%, 92%, 93%, 94%, 95%, 96%, 97%, 98%, 99% sequence identity to SEQ ID NO:226 or SEQ ID NO:227. In some embodiments, the variant CD80 polypeptide is linked indirectly via a linker.

In some embodiments of any one of the variant CD80 polypeptides that is a transmembrane immunomodulatory protein, the variant CD80 polypeptide further contains a transmembrane domain linked to the extracellular domain (ECD) or specific binding fragment thereof of the variant CD80 polypeptide. In some embodiments, the transmembrane domain contains the sequence of amino acids set forth as residues 243-263 of SEQ ID NO: 1 or a functional variant thereof that exhibits at least 85% sequence identity to residues 243-263 of SEQ ID NO: 1. In some embodiments, the variant CD80 polypeptide further contains a cytoplasmic signaling domain linked to the transmembrane domain. In some embodiments, the cytoplasmic signaling domain contains the sequence of amino acids set forth as residues 264-288 of SEQ ID NO: 1 or a functional variant thereof that exhibits at least 85%, 86%, 87%, 88%, 89%, 90%, 91%, 92%, 93%, 94%, 95%, 96%, 97%, 98%, 99% sequence identity to residues 264-288 of SEQ ID NO: 1.

In some embodiments of any one of the variant CD80 polypeptides, the variant CD80 increases IFN-gamma (interferon-gamma) expression relative to the unmodified CD80 in an in vitro primary T-cell assay. In some embodiments of any one of the variant CD80 polypeptides, the variant CD80 decreases IFN-gamma (interferon-gamma) expression relative to the unmodified CD80 in an in vitro primary T-cell assay. In some embodiments of any one of the variant CD80 polypeptides, the variant CD80 polypeptide is deglycosylated.

In some embodiments, provided herein is an immunomodulatory polypeptide comprising the variant CD80 according to any one of the embodiments described herein linked to a second polypeptide comprising an immunoglobulin superfamily (IgSF) domain. In some embodiments, the IgSF domain is affinity modified and exhibits altered binding to one or more of its cognate binding partner(s) compared to the unmodified or wild-type IgSF domain. In some embodiments, the IgSF domain exhibits increased binding to one or more of its cognate binding partner(s) compared to the unmodified or wild-type IgSF domain. In some embodiments, the variant CD80 is a first variant CD80 and the IgSF domain of the second polypeptide is an IgSF domain from a second variant CD80 according to any one of the embodiments described herein, wherein the first and second variant CD80 are the same or different. In some embodiments, the variant CD80 polypeptide is capable of specifically binding to CD28, PD-L1, or CTLA-4, and the IgSF domain of the second polypeptide is capable of binding to a cognate binding partner other than one specifically bound by the variant CD80 polypeptide. In some embodiments, the variant CD80 polypeptide is capable of specifically binding to CD28 or PD-L1, and the IgSF domain is capable of binding to a cognate binding partner other than one specifically bound by the variant CD80 polypeptide. In some embodiments, the variant CD80 polypeptide is capable of specifically binding to CD28 or CTLA-4, and the IgSF domain is capable of binding to a cognate binding partner other than one specifically bound by the variant CD80 polypeptide. In some embodiments, the variant CD80 polypeptide is capable of specifically binding to CTLA-4 or PD-L1 and the IgSF domain is capable of binding to a cognate binding partner other than one specifically bound by the variant CD80 polypeptide. In some embodiments, the IgSF domain is from a member of the B7 family. In some embodiments, the IgSF domain is a tumor-localizing moiety that binds to a ligand expressed on a tumor. In some embodiments, the ligand is B7H6. In some embodiments, the IgSF domain is from NKp30. In some embodiments, the IgSF domain is affinity modified and exhibits increased binding to one or more of its cognate binding partner(s) compared to the unmodified or wild-type IgSF domain. In some embodiments, the IgSF domain is or contains an IgV domain. In some embodiments, the variant CD80 polypeptide is or contains an IgV domain.

In some embodiments according to any one of the immunomodulatory proteins, the immunomodulatory protein contains a multimerization domain linked to one or both of the variant CD80 polypeptide and the second polypeptide comprising the IgSF domain. In some embodiments, the multimerization domain is an Fc domain or a variant thereof with reduced effector function. In some embodiments, the immunomodulatory protein is dimeric. In some embodiments, the immunomodulatory protein is homodimeric. In some cases, the immunomodulatory protein is heterodimeric.

In some embodiments, provided herein is a conjugate comprising a variant CD80 according to any one of the embodiments described herein or an immunomodulatory polypeptide according to any one of the embodiments described herein linked to a moiety. In some embodiments, the moiety is a targeting moiety that specifically binds to a molecule on the surface of a cell. In some embodiments, the targeting moiety specifically binds to a molecule on the surface of an immune cell. In some embodiments, the immune cell is an antigen presenting cell or a lymphocyte. In some embodiments, the targeting moiety is a tumor-localizing moiety that binds to a molecule on the surface of a tumor. In some embodiments, the moiety is a protein, a peptide, nucleic acid, small molecule or nanoparticle. In some embodiments, the moiety is an antibody or antigen-binding fragment. In some of any such embodiments, the conjugate is divalent, tetravalent, hexavalent or octavalent.

In some embodiments, provided herein is a nucleic acid molecule encoding a variant CD80 according to any one of the embodiments described herein or an immunomodulatory polypeptide according to any one of the embodiments described herein. In some embodiments, the nucleic acid molecule is a synthetic nucleic acid. In some embodiments, the nucleic acid is cDNA.

In some embodiments, provided herein is a vector comprising the nucleic acid of any one of the embodiments described herein. In some embodiments, the vector is an expression vector.

In some embodiments, the vector is a mammalian vector or a viral vector.

In some embodiments, provided herein is a cell comprising the vector according to any one of the embodiments described herein. In some embodiments, the cell is a mammalian cell. In some embodiments, the cell is a human cell.

In some embodiments, provided herein is a method of producing a variant CD80 polypeptide or an immunomodulatory protein, comprising introducing the nucleic acid molecule according to any one of the embodiments described herein or vector according to any one of the embodiments described herein into a host cell under conditions to express the protein in the cell. In some embodiments, the method further includes isolating or purifying the variant CD80 polypeptide or immunomodulatory protein from the cell.

In some embodiments, provided herein is a method of engineering a cell expressing a variant CD80 polypeptide, comprising introducing a nucleic acid molecule encoding the variant CD80 polypeptide according to any one of the embodiments described herein into a host cell under conditions in which the polypeptide is expressed in the cell.

In some embodiments, provided herein is an engineered cell, expressing the variant CD80 polypeptide according to any one of the embodiments described herein, the immunomodulatory protein according to any one of the embodiments described herein, the nucleic acid molecule according to any one of the embodiments described herein, or the vector according to any one of the embodiments described herein. In some embodiments, the variant CD80 polypeptide or immunomodulatory polypeptide contains a signal peptide. In some aspects, the variant CD80 polypeptide or immunomodulatory polypeptide does not contain a transmembrane domain and/or is not expressed on the surface of the cell. In some embodiments, the variant CD80 polypeptide or immunomodulatory polypeptide is secreted from the engineered cell.

In some embodiments, the engineered cell contains a variant CD80 polypeptide that contains a transmembrane domain and/or is the transmembrane immunomodulatory protein according to any one of the embodiments described herein. In some embodiments, the variant CD80 polypeptide is expressed on the surface of the cell.

In some embodiments, the engineered cell is an immune cell. In some embodiments, the immune cell is an antigen presenting cell (APC) or a lymphocyte. In some embodiments, the engineered cell is a primary cell. In some embodiments, the engineered cell is a mammalian cell. In some embodiments, the engineered cell is a human cell. In some embodiments, the lymphocyte is a T cell. In some embodiments, the APC is an artificial APC.

In some of any such embodiments, the engineered cell further contains a chimeric antigen receptor (CAR) or an engineered T-cell receptor.

Also provided is an infectious agent, comprising a nucleic acid molecule encoding a variant CD80 polypeptide according to any one of the embodiments described herein or an immunomodulatory polypeptide according to any one of the embodiments described herein. In some instances, the encoded variant CD80 polypeptide or immunomodulatory polypeptide does not contain a transmembrane domain and/or is not expressed on the surface of a cell in which it is expressed. In some embodiments, the encoded variant CD80 polypeptide or immunomodulatory polypeptide is secreted from a cell in which it is expressed. In some aspects, the encoded variant CD80 polypeptide contains a transmembrane domain. In some aspects, the encoded variant CD80 polypeptide is expressed on the surface of a cell in which it is expressed.

In some of any such embodiments, the infectious agent is a bacterium or a virus. In some cases, the virus is an oncolytic virus. In some embodiments, the oncolytic virus is an adenoviruses, adeno-associated viruses, herpes viruses, Herpes Simplex Virus, Vesticular Stomatic virus, Reovirus, Newcastle Disease virus, parvovirus, measles virus, vesticular stomatitis virus (VSV), Coxsackie virus or a Vaccinia virus. In some embodiments, the virus specifically targets dendritic cells (DCs) and/or is dendritic cell-tropic. In some instances, the virus is a lentiviral vector that is pseudotyped with a modified Sindbis virus envelope product.

In some of any such embodiments, the infectious agent further contains a nucleic acid molecule encoding a further gene product that results in death of a target cell or that can augment or boost an immune response. In some embodiments, the further gene product is selected from an anticancer agent, anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic gene product, a cell matrix degradative gene, genes for tissue regeneration or a reprogramming human somatic cells to pluripotency.

In some embodiments, provided herein is a pharmaceutical composition, comprising the variant CD80 polypeptide according to any one of the embodiments described herein, an immunomodulatory protein according to any one of the embodiments described herein, a conjugate according to any one of the embodiments described herein, or an engineered cell according to any one of the embodiments described herein. In some embodiments, the pharmaceutical composition further includes a pharmaceutically acceptable excipient. In some embodiments, the pharmaceutical composition is sterile.

In some embodiments, provided herein is an article of manufacture comprising the pharmaceutical composition according to any one of the embodiments described herein in a vial. In some embodiments, the vial is sealed.

In some embodiments, provided herein is a kit comprising the pharmaceutical composition according to any one of the embodiments described herein and instructions for use. In some embodiments, provided herein is a kit comprising the article of manufacture according to any one of the embodiments described herein and instructions for use.

In some embodiments, provided herein is a method of modulating an immune response in a subject, comprising administering the pharmaceutical composition according to any one of the embodiments described herein to the subject. In some embodiments, the method includes administering the engineered cells according to any one of the embodiments described herein. In some embodiments, the engineered cells are autologous to the subject. In some embodiments, the engineered cells are allogenic to the subject In some embodiments, modulating the immune response treats a disease or condition in the subject. In some embodiments, the immune response is increased. In some embodiments, an immunomodulatory protein or conjugate comprising a variant CD80 polypeptide linked to a tumor-localizing moiety is administered to the subject. In some cases, the tumor-localizing moiety is or contains a binding molecule that recognizes a tumor antigen. In some instances, the binding molecule contains an antibody or an antigen-binding fragment thereof or contains a wild-type IgSF domain or variant thereof.

In some embodiments, a pharmaceutical composition comprising the immunomodulatory protein according to any one of the embodiments described herein or the conjugate according to any one of the embodiments described herein is administered to the subject. In some embodiments, an engineered cell comprising a variant CD80 polypeptide that is a transmembrane immunomodulatory protein is administered to the subject and/or the engineered cell according to any one of the embodiments described herein is administered to the subject.

In some embodiments, an infectious agent encoding a variant CD80 polypeptide that is a transmembrane immunomodulatory protein is administered to the subject, optionally under conditions in which the infectious agent infects a tumor cell or immune cell and the transmembrane immunomodulatory protein is expressed on the surface of the infected cell. In some aspects, the transmembrane immunomodulatory protein is a transmembrane immunomodulatory protein according to any one of the embodiments described herein.

In some embodiments, the disease or condition is a tumor or cancer. In some embodiments, the disease or condition is selected from melanoma, lung cancer, bladder cancer, hematological malignancy, liver cancer, brain cancer, renal cancer, breast cancer, pancreatic cancer, colorectal cancer, spleen cancer, prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer.

In some embodiments, the immune response is decreased by the provided methods of modulating the immune response.

In some embodiments, a variant CD80 polypeptide or immunomodulatory protein that is soluble is administered to the subject. In some cases, the soluble polypeptide or immunomodulatory protein is an Fc fusion protein. In some of any such embodiments, a pharmaceutical composition comprising a variant CD80 polypeptide according to any one of the embodiments described herein, or the immunomodulatory protein according to any one of the embodiments described herein is administered to the subject. In some embodiments, an engineered cell comprising a secretable variant CD80 polypeptide is administered to the subject. In some embodiments, an engineered cell according to any one of the embodiments described herein is administered to the subject.

In some embodiments, an infectious agent encoding a variant CD80 polypeptide that is a secretable immunomodulatory protein is administered to the subject, optionally under conditions in which the infectious agent infects a tumor cell or immune cell and the secretable immunomodulatory protein is secreted from the infected cell.

In some of any such embodiments, the disease or condition is an inflammatory or autoimmune disease or condition. In some embodiments, the disease or condition is an Antineutrophil cytoplasmic antibodies (ANCA-associated vasculitis, a vasculitis, an autoimmune skin disease, transplantation, a Rheumatic disease, an inflammatory gastrointestinal disease, an inflammatory eye disease, an inflammatory neurological disease, an inflammatory pulmonary disease, an inflammatory endocrine disease, or an autoimmune hematological disease. In some embodiments, the disease or condition is selected from inflammatory bowel disease, transplant, Crohn's disease, ulcerative colitis, multiple sclerosis, asthma, rheumatoid arthritis, or psoriasis.

BRIEF DESCRIPTION OF THE DRAWINGS

FIG. 1A depicts soluble molecules, including: (1) a variant IgSF domain (vIgD), e.g. variant CD80, fused to an Fc chain; (2) a stack molecule containing a first variant IgSF domain (first vIgD), e.g. variant CD80, and a second IgSF domain, such as a second variant IgSF domain (second vIgD); (3) a tumor targeting IgSF molecule containing a first variant IgSF domain (vIgD), e.g. variant CD80, and an IgSF domain that targets to a tumor antigen, such as an NkP30 IgSF domain; and (4) a variant IgSF domain (vIgD), e.g. variant CD80, linked to an antibody (V-Mab). FIG. 1B depicts a transmembrane immunomodulatory protein (TIP) containing a variant IgSF domain (vIgD) expressed on the surface of a cell. In an exemplary embodiment, the cognate binding partner of the transmembrane bound vIgD is a costimulatory receptor, and the TIP containing the vIgD (e.g. CD80 vIgD) agonizes the costimulatory receptor such that the TIP induces a positive signal in the cell expressing the costimulatory receptor. FIG. 1C depicts a secreted immunomodulatory protein (SIP) in which a variant IgSF domain (vIgD) is secreted from a cell, such as a first T cell (e.g. CAR T cell). In an exemplary embodiment, the cognate binding partner of the secreted vIgD is an activating receptor, e.g. CD28, which can be expressed on the first cell (e.g. T cell) and/or on a second cell (e.g. T cell; either endogenous or engineered, such as a CAR T cell). Upon binding of the SIP with its cognate binding partner, signaling via the activating receptor is blocked. In all cases, the vIgD can be a V-domain (IgV) only, the combination of the V-domain (IgV) and C-domain (IgC), including the entire extracellular domain (ECD), or any combination of Ig domains of the IgSF superfamily member.

FIG. 6A shows various configurations in which a vIgD is linked, directly or indirectly, to the N- and/or C-terminus of the light chain of an antibody. FIG. 6B shows various configurations in which a vIgD is linked, directly or indirectly, to the N- and/or C-terminus of the heavy chain of an antibody. FIG. 6C depicts the resulting V-Mab configurations when a light chain of FIG. 6A and a heavy chain of FIG. 6B are co-expressed in a cell.

DETAILED DESCRIPTION

Figure 1A:
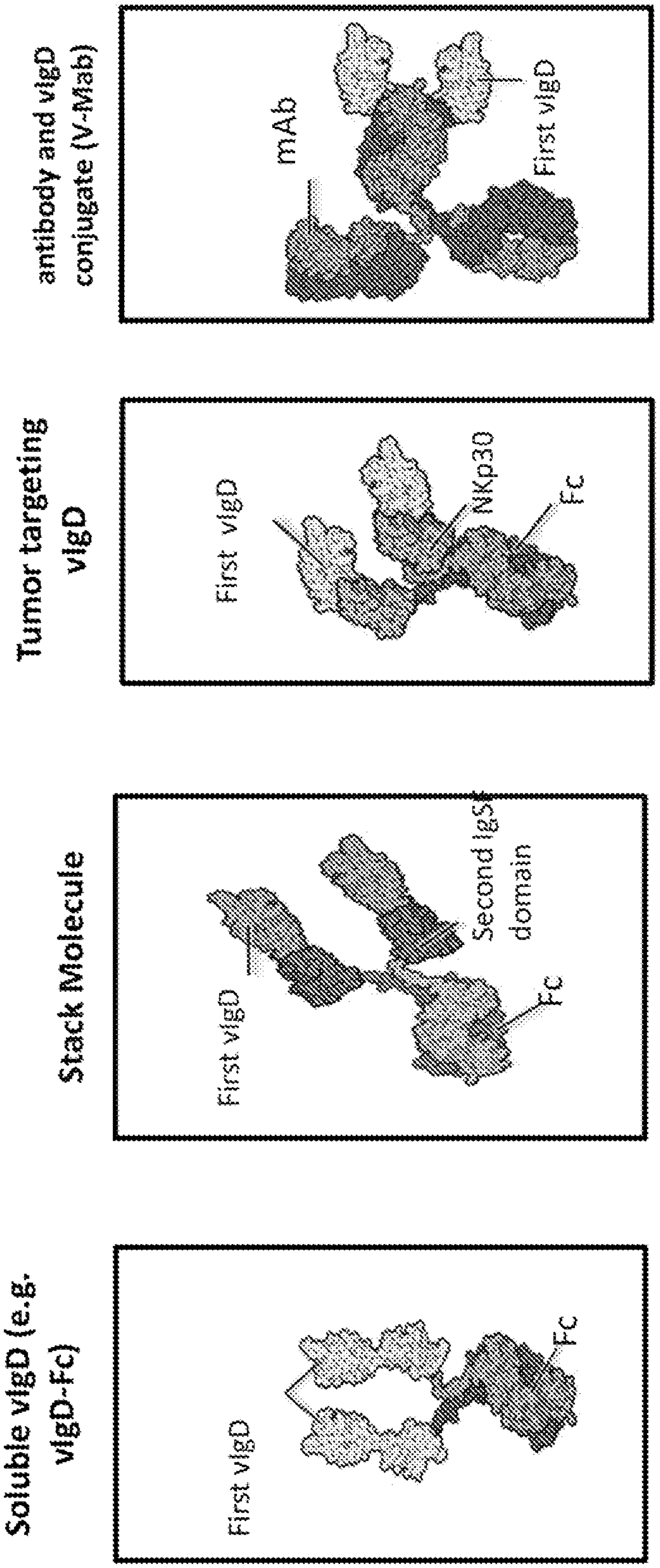
FIG. 1A-1C depicts various formats of the provided variant IgSF domain molecules.

Provided herein are immunomodulatory proteins that are or comprise variants or mutants of CD80 and specific binding fragments thereof that exhibit altered binding activity or affinity to at least one target ligand cognate binding partner (also called counter-structure ligand protein). In some embodiments, the variant CD80 polypeptides contain one or more amino acid modifications (e.g., amino acid substitutions, deletions, or additions) compared to an unmodified or wild-type CD80 polypeptide. In some embodiments, the variant CD80 polypeptides contain one or more amino acid modifications (e.g., substitutions) compared to an unmodified or wild-type CD80 polypeptide. In some embodiments, the one or more amino acid modifications (e.g., substitutions) are in an IgSF domain (e.g. IgV) of an unmodified or wild-type CD80 polypeptide. In some embodiments, the altered binding activity or affinity, such as increased or decreased binding activity or affinity, is for at least one of the cognate binding partner proteins CD28, PD-L1, or CTLA-4. In some embodiments, the variant CD80 polypeptides exhibit altered, such as increased or decreased, binding activity or affinity to one or more of CD28, PD-L1, or CTLA-4 compared to the unmodified or wild-type CD80 not containing the one or more modifications. In some embodiments, the immunomodulatory proteins are soluble. In some embodiments, the immunomodulatory proteins are transmembrane immunomodulatory proteins capable of being expressed on the surface of cells. In some embodiments, also provided herein are one or more other immunomodulatory proteins that are conjugates or fusions containing a variant CD80 polypeptide provided herein and one or more other moiety or polypeptide.

In some embodiments, the variant CD80 polypeptides exhibit increased binding affinity to one or more of CD28, PD-L, or CTLA-4 compared to the unmodified or wild-type CD80 not containing the one or more modifications. In some embodiments, the variant CD80 polypeptides exhibit decreased binding affinity to one or more of CD28, PD-L1, or CTLA-4 compared to the unmodified or wild-type CD80 not containing the one or more modifications. In some embodiments, the variant CD80 polypeptides exhibit increased binding affinity to one or more of CD28, PD-L1, or CTLA-4, and decreased binding affinity to another one or more of CD28, PD-L1, or CTLA-4 compared to the unmodified or wild-type CD80 not containing the one or more modifications.

In some embodiments, also provided herein are one or more other immunomodulatory proteins that are conjugates or fusions containing a variant CD80 polypeptide provided herein and one or more other moiety or polypeptide. In some embodiments, the variant CD80 polypeptides and immunomodulatory proteins modulate an immunological immune response, such an increase or decrease an immune response. In some embodiments, the variant CD80 polypeptides and immunomodulatory proteins provided herein can be used for the treatment of diseases or conditions that are associated with a dysregulated immune response.

In some embodiments, the provided variant CD80 polypeptides modulate T cell activation via interactions with costimulatory signaling molecules. In general, antigen specific T-cell activation generally requires two distinct signals. The first signal is provided by the interaction of the T-cell receptor (TCR) with major histocompatibility complex (MHC) associated antigens present on antigen presenting cells (APCs). The second signal is costimulatory to TCR engagement and necessary to avoid T-cell apoptosis or anergy.

In some embodiments, under normal physiological conditions, the T cell-mediated immune response is initiated by antigen recognition by the T cell receptor (TCR) and is regulated by a balance of co-stimulatory and inhibitory signals (e.g., immune checkpoint proteins). The immune system relies on immune checkpoints to prevent autoimmunity (i.e., self-tolerance) and to protect tissues from excessive damage during an immune response, for example during an attack against a pathogenic infection. In some cases, however, these immunomodulatory proteins can be dysregulated in diseases and conditions, including tumors, as a mechanism for evading the immune system.

In some embodiments, among known T-cell costimulatory receptors is CD28, which is the T-cell costimulatory receptor for the ligands B7-1 (CD80) and B7-2 (CD86) both of which are present on APCs. These same ligands can also bind to the inhibitory T-cell receptor CTLA-4 (cytotoxic T-lymphocyte-associated protein 4) with greater affinity than for CD28; the binding to CTLA-4 acts to down-modulate the immune response. Likewise, CD80 is able to bind to programmed death ligand 1 (PD-L1). PD-L1 also is a negative regulator of immune activation and is capable of down-modulating the immune response via interactions with programmed death 1 (PD-1) receptor. The binding of CD80 to PD-L1 can block the interaction between PD-L1 and PD-1, and thereby potentiate or enhance the immune response. Thus, in some cases, interactions of CD80 with CD28 and PD-L1 yield overlapping and complementary effects.

In some embodiments, CD28 and PD-L1 may play complementary roles in modulating an immune response.

Enhancement or suppression of the activity of these receptors has clinical significance for treatment of inflammatory and autoimmune disorders, cancer, and viral infections. In some cases, however, therapies to intervene and alter the costimulatory effects of both receptors are constrained by the spatial orientation requirements as well as size limitations imposed by the confines of the immunological synapse. In some aspects, existing therapeutic drugs, including antibody drugs, may not be able to interact simultaneously with the multiple target proteins involved in modulating these interactions. In addition, in some cases, existing therapeutic drugs may only have the ability to antagonize, but not agonize, an immune response. Additionally, pharmacokinetic differences between drugs that independently target one or the other of these two receptors can create difficulties in properly maintaining a desired blood concentration of such drug combinations throughout the course of treatment.

In some embodiments, the provided variant CD80 polypeptides or immunomodulatory proteins modulate (e.g. increase or decrease) immunological activity induced or associated with costimulatory receptors CD28 or PD-L1 and, in some cases, CTLA-4. Thus, in some embodiments, the provided polypeptides overcome these constraints by providing variants CD80 with independent binding affinities to both CD28 and PD-L1, and, in some cases, CTLA-4, thereby agonizing or antagonizing the complementary effects of costimulation by receptors. Methods of making and using these variants of CD80 are also provided.

All publications, including patents, patent applications scientific articles and databases, mentioned in this specification are herein incorporated by reference in their entirety for all purposes to the same extent as if each individual publication, including patent, patent application, scientific article or database, were specifically and individually indicated to be incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

The section headings used herein are for organizational purposes only and are not to be construed as limiting the subject matter described.

I. DEFINITIONS

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

The terms used throughout this specification are defined as follows unless otherwise limited in specific instances. As used in the specification and the appended claims, the singular forms "a," "an," and "the" include plural referents unless the context clearly dictates otherwise. Unless defined otherwise, all technical and scientific terms, acronyms, and abbreviations used herein have the same meaning as commonly understood by one of ordinary skill in the art to which the invention pertains. Unless indicated otherwise, abbreviations and symbols for chemical and biochemical names is per IUPAC-IUB nomenclature. Unless indicated otherwise, all numerical ranges are inclusive of the values defining the range as well as all integer values in-between.

The term "affinity modified" as used in the context of an immunoglobulin superfamily domain, means a mammalian immunoglobulin superfamily (IgSF) domain having an altered amino acid sequence (relative to the corresponding wild-type parental or unmodified IgSF domain) such that it has an increased or decreased binding affinity or avidity to at least one of its cognate binding partners (alternatively "counter-structures") compared to the parental wild-type or unmodified (i.e., non-affinity modified) IgSF control domain. Included in this context is an affinity modified CD80 IgSF domain. In some embodiments, the affinity-modified IgSF domain can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions, in a wildtype or unmodified IgSF domain. An increase or decrease in binding affinity or avidity can be determined using well known binding assays such as flow cytometry. Larsen et al., American Journal of Transplantation, Vol 5: 443-453 (2005). See also, Linsley et al., Immunity, 1: 7930801 (1994). An increase in a protein's binding affinity or avidity to its cognate binding partner(s) is to a value at least 10% greater than that of the wild-type IgSF domain control and in some embodiments, at least 20%, 30%, 40%, 50%, 100%, 200%, 300%, 500%, 1000%, 5000%, or 10000% greater than that of the wild-type IgSF domain control value. A decrease in a protein's binding affinity or avidity to at least one of its cognate binding partner is to a value no greater than 90% of the control but no less than 10% of the wild-type IgSF domain control value, and in some embodiments no greater than 80%, 70% 60%, 50%, 40%, 30%, or 20% but no less than 10% of the wild-type IgSF domain control value. An affinity-modified protein is altered in primary amino acid sequence by substitution, addition, or deletion of amino acid residues. The term "affinity modified IgSF domain" is not be construed as imposing any condition for any particular starting composition or method by which the affinity-modified IgSF domain was created. Thus, the affinity modified IgSF domains of the present invention are not limited to wild type IgF domains that are then transformed to an affinity modified IgSF domain by any particular process of affinity modification. An affinity modified IgSF domain polypeptide can, for example, be generated starting from wild type mammalian IgSF domain sequence information, then modeled in silico for binding to its cognate binding partner, and finally recombinantly or chemically synthesized to yield the affinity modified IgSF domain composition of matter. In but one alternative example, an affinity modified IgSF domain can be created by site-directed mutagenesis of a wild-type IgSF domain. Thus, affinity modified IgSF domain denotes a product and not necessarily a product produced by any given process. A variety of techniques including recombinant methods, chemical synthesis, or combinations thereof, may be employed.

The term "allogeneic" as used herein means a cell or tissue that is removed from one organism and then infused or adoptively transferred into a genetically dissimilar organism of the same species. In some embodiments of the invention, the species is murine or human.

The term "autologous" as used herein means a cell or tissue that is removed from the same organism to which it is later infused or adoptively transferred. An autologous cell or tissue can be altered by, for example, recombinant DNA methodologies, such that it is no longer genetically identical to the native cell or native tissue which is removed from the organism. For example, a native autologous T-cell can be genetically engineered by recombinant DNA techniques to become an autologous engineered cell expressing a transmembrane immunomodulatory protein and/or chimeric antigen receptor (CAR), which in some cases involves engineering a T-cell or TIL (tumor infiltrating lymphocyte). The engineered cells are then infused into a patient from which the native T-cell was isolated. In some embodiments, the organism is human or murine.

The terms "binding affinity," and "binding avidity" as used herein means the specific binding affinity and specific binding avidity, respectively, of a protein for its counter-structure under specific binding conditions. In biochemical kinetics avidity refers to the accumulated strength of multiple affinities of individual non-covalent binding interactions, such as between CD80 and its counter-structures PD-L1, CD28, and/or CTLA-4. As such, avidity is distinct from affinity, which describes the strength of a single interaction. An increase or attenuation in binding affinity of a variant CD80 containing an affinity modified CD80 IgSF domain to its counter-structure is determined relative to the binding affinity of the unmodified CD80, such as an unmodified CD80 containing the native or wild-type IgSF domain, such as IgV domain. Methods for determining binding affinity or avidity are known in art. See, for example, Larsen et al., American Journal of Transplantation, Vol 5: 443-453 (2005). In some embodiments, a variant CD80, such as containing an affinity modified IgSF domain, specifically binds to CD28, PD-L1 and/or CTLA-4 measured by flow cytometry with a binding affinity that yields a Mean Fluorescence Intensity (MFI) value at least 10%, 20%, 30%, 40%, 50%, 60%, 70%, 80%, 90%, or 100% greater than an unmodified CD80 control in a binding assay such as described in Example 6.

The term "biological half-life" refers to the amount of time it takes for a substance, such as an immunomodulatory polypeptide comprising a variant CD80 polypeptide of the present invention, to lose half of its pharmacologic or physiologic activity or concentration. Biological half-life can be affected by elimination, excretion, degradation (e.g., enzymatic) of the substance, or absorption and concentration in certain organs or tissues of the body. In some embodiments, biological half-life can be assessed by determining the time it takes for the blood plasma concentration of the substance to reach half its steady state level ("plasma half-life"). Conjugates that can be used to derivatize and increase the biological half-life of polypeptides of the invention are known in the art and include, but are not limited to, polyethylene glycol (PEG), hydroxyethyl starch (HES), XTEN (extended recombinant peptides; see, WO2013130683), human serum albumin (HSA), bovine serum albumin (BSA), lipids (acylation), and poly-Pro-Ala-Ser (PAS), polyglutamic acid (glutamylation).

The term "chimeric antigen receptor" or "CAR" as used herein refers to an artificial (i.e., man-made) transmembrane protein expressed on a mammalian cell comprising at least an ectodomain, a transmembrane, and an endodomain. Optionally, the CAR protein includes a "spacer" which covalently links the ectodomain to the transmembrane domain. A spacer is often a polypeptide linking the ectodomain to the transmembrane domain via peptide bonds. The CAR is typically expressed on a mammalian lymphocyte. In some embodiments, the CAR is expressed on a mammalian cell such as a T-cell or a tumor infiltrating lymphocyte (TIL). A CAR expressed on a T-cell is referred to herein as a "CAR T-cell" or "CAR-T." In some embodiments the CAR-T is a T helper cell, a cytotoxic T-cell, a natural killer T-cell, a memory T-cell, a regulatory T-cell, or a gamma delta T-cell. When used clinically in, e.g. adoptive cell transfer, a CAR-T with antigen binding specificity to the patient's tumor is typically engineered to express on a native T-cell obtained from the patient. The engineered T-cell expressing the CAR is then infused back into the patient. The CAR-T is thus often an autologous CAR-T although allogeneic CAR-T are included within the scope of the invention. The ectodomain of a CAR comprises an antigen binding region, such as an antibody or antigen binding fragment thereof (e.g. scFv), that specifically binds under physiological conditions with a target antigen, such as a tumor specific antigen Upon specific binding a biochemical chain of events (i.e., signal transduction) results in modulation of the immunological activity of the CAR-T. Thus, for example, upon specific binding by the antigen binding region of the CAR-T to its target antigen can lead to changes in the immunological activity of the T-cell activity as reflected by changes in cytotoxicity, proliferation or cytokine production. Signal transduction upon CAR-T activation is achieved in some embodiments by the CD3-zeta chain ("CD3-z") which is involved in signal transduction in native mammalian T-cells. CAR-Ts can further comprise multiple signaling domains such as CD28, 41BB or OX40, to further modulate immunomodulatory response of the T-cell. CD3-z comprises a conserved motif known as an immunoreceptor tyrosine-based activation motif (ITAM) which is involved in T-cell receptor signal transduction.

The term "collectively" or "collective" when used in reference to cytokine production induced by the presence of two or more variant CD80 polypeptides in an in vitro assay, means the overall cytokine expression level irrespective of the cytokine production induced by individual variant CD80 polypeptides. In some embodiments, the cytokine being assayed is IFN-gamma in an in vitro primary T-cell assay such as described in Example 7.

The term "cognate binding partner" (used interchangeably with "counter-structure") in reference to a polypeptide, such as in reference to an IgSF domain ofa variant CD80, refers to at least one molecule (typically a native mammalian protein) to which the referenced polypeptide specifically binds under specific binding conditions. In some aspects, a variant CD80 containing an affinity modified IgSF domain specifically binds to the counter-structure of the corresponding native or wildtype CD80 but with increased or attenuated affinity. A species of ligand recognized and specifically binding to its cognate receptor under specific binding conditions is an example of a counter-structure or cognate binding partner of that receptor. A "cognate cell surface binding partner" is a cognate binding partner expressed on a mammalian cell surface. A "cell surface molecular species" is a cognate binding partner of ligands of the immunological synapse (IS), expressed on and by cells, such as mammalian cells, forming the immunological synapse.

As used herein, "conjugate," "conjugation" or grammatical variations thereof refers the joining or linking together of two or more compounds resulting in the formation of another compound, by any joining or linking methods known in the art. It can also refer to a compound which is generated by the joining or linking together two or more compounds. For example, a variant CD80 polypeptide linked directly or indirectly to one or more chemical moieties or polypeptide is an exemplary conjugate. Such conjugates include fusion proteins, those produced by chemical conjugates and those produced by any other methods.

The term "competitive binding" as used herein means that a protein is capable of specifically binding to at least two cognate binding partners but that specific binding of one cognate binding partner inhibits, such as prevents or precludes, simultaneous binding of the second cognate binding partner. Thus, in some cases, it is not possible for a protein to bind the two cognate binding partners at the same time. Generally, competitive binders contain the same or overlapping binding site for specific binding but this is not a requirement. In some embodiments, competitive binding causes a measurable inhibition (partial or complete) of specific binding of a protein to one of its cognate binding partner due to specific binding of a second cognate binding partner. A variety of methods are known to quantify competitive binding such as ELISA (enzyme linked immunosorbent assay) assays.

The term “conservative amino acid substitution” as used herein means an amino acid substitution in which an amino acid residue is substituted by another amino acid residue having a side chain R group with similar chemical properties (e.g., charge or hydrophobicity). Examples of groups of amino acids that have side chains with similar chemical properties include 1) aliphatic side chains: glycine, alanine, valine, leucine, and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartic acid and glutamic acid; and 7) sulfur-containing side chains: cysteine and methionine. Conservative amino acids substitution groups are: valine-leucine-isoleucine, phenylalanine-tyrosine, lysine-arginine, alanine-valine, glutamate-aspartate, and asparagine-glutamine.

The term, “corresponding to” with reference to positions of a protein, such as recitation that nucleotides or amino acid positions “correspond to” nucleotides or amino acid positions in a disclosed sequence, such as set forth in the Sequence Listing, refers to nucleotides or amino acid positions identified upon alignment with the disclosed sequence based on structural sequence alignment or using a standard alignment algorithm, such as the GAP algorithm. For example, corresponding residues can be determined by alignment of a reference sequence with the sequence of wild-type CD80 set forth in SEQ ID NO:28 (ECD domain) or set forth in SEQ ID NO: 152 or 372 (IgV domain) by structural alignment methods as described herein. By aligning the sequences, one skilled in the art can identify corresponding residues, for example, using conserved and identical amino acid residues as guides.

The terms “decrease” or “attenuate” “or suppress” as used herein means to decrease by a statistically significant amount. A decrease can be at least 10%, 20%, 30%, 40%, 50%, 60%, 70%, 80%, 90%, or 100%.

The terms “derivatives” or “derivatized” refer to modification of a protein by covalently linking it, directly or indirectly, to a composition so as to alter such characteristics as biological half-life, bioavailability, immunogenicity, solubility, toxicity, potency, or efficacy while retaining or enhancing its therapeutic benefit. Derivatives of immunomodulatory polypeptides of the invention are within the scope of the invention and can be made by, for example, glycosylation, pegylation, lipidation, or Fc-fusion.

As used herein, domain (typically a sequence of three or more, generally 5 or 7 or more amino acids, such as 10 to 200 amino acid residues) refers to a portion of a molecule, such as a protein or encoding nucleic acid, that is structurally and/or functionally distinct from other portions of the molecule and is identifiable. For example, domains include those portions of a polypeptide chain that can form an independently folded structure within a protein made up of one or more structural motifs and/or that is recognized by virtue of a functional activity, such as binding activity. A protein can have one, or more than one, distinct domains. For example, a domain can be identified, defined or distinguished by homology of the primary sequence or structure to related family members, such as homology to motifs. In another example, a domain can be distinguished by its function, such as an ability to interact with a biomolecule, such as a cognate binding partner. A domain independently can exhibit a biological function or activity such that the domain independently or fused to another molecule can perform an activity, such as, for example binding. A domain can be a linear sequence of amino acids or a non-linear sequence of amino acids. Many polypeptides contain a plurality of domains. Such domains are known, and can be identified by those of skill in the art. For exemplification herein, definitions are provided, but it is understood that it is well within the skill in the art to recognize particular domains by name. If needed appropriate software can be employed to identify domains.

The term “ectodomain” as used herein refers to the region of a membrane protein, such as a transmembrane protein, that lies outside the vesicular membrane. Ectodomains often comprise binding domains that specifically bind to ligands or cell surface receptors, such as via a binding domain that specifically binds to the ligand or cell surface receptor. The ectodomain of a cellular transmembrane protein is alternately referred to as an extracellular domain.

The terms “effective amount” or “therapeutically effective amount” refer to a quantity and/or concentration of a therapeutic composition of the invention, including a protein composition or cell composition, that when administered ex vivo (by contact with a cell from a patient) or in vivo (by administration into a patient) either alone (i.e., as a monotherapy) or in combination with additional therapeutic agents, yields a statistically significant decrease in disease progression as, for example, by ameliorating or eliminating symptoms and/or the cause of the disease. An effective amount may be an amount that relieves, lessens, or alleviates at least one symptom or biological response or effect associated with a disease or disorder, prevents progression of the disease or disorder, or improves physical functioning of the patient. In the case of cell therapy, the effective amount is an effective dose or number of cells administered to a patient by adoptive cell therapy. In some embodiments the patient is a mammal such as a non-human primate or human patient.

The term “endodomain” as used herein refers to the region found in some membrane proteins, such as transmembrane proteins, that extends into the interior space defined by the cell surface membrane. In mammalian cells, the endodomain is the cytoplasmic region of the membrane protein. In cells, the endodomain interacts with intracellular constituents and can be play a role in signal transduction and thus, in some cases, can be an intracellular signaling domain. The endodomain of a cellular transmembrane protein is alternately referred to as a cytoplasmic domain, which, in some cases, can be a cytoplasmic signaling domain.

The terms “enhanced” or “increased” as used herein in the context of increasing immunological activity of a mammalian lymphocyte means to increase one or more activities the lymphocyte. An increased activity can be one or more of increase cell survival, cell proliferation, cytokine production, or T-cell cytotoxicity, such as by a statistically significant amount. In some embodiments, reference to increased immunological activity means to increase interferon gamma (IFN-gamma) production, such as by a statistically significant amount. In some embodiments, the immunological activity can be assessed in a mixed lymphocyte reaction (MLR) assay. Methods of conducting MLR assays are known in the art. Wang et al., Cancer Immunol Res. 2014 September: 2(9):846-56. Other methods of assessing activities of lymphocytes are known in the art, including any assay as described herein. In some embodiments an enhancement can be an increase of at least 10%, 20%, 30%, 40%, 50%, 75%, 100%, 200%, 300%, 400%, or 500% greater than a non-zero control value.

The term "engineered cell" as used herein refers to a mammalian cell that has been genetically modified by human intervention such as by recombinant DNA methods or viral transduction. In some embodiments, the cell is an immune cell, such as a lymphocyte (e.g. T cell, B cell, NK cell) or an antigen presenting cell (e.g. dendritic cell). The cell can be a primary cell from a patient or can be a cell line. In some embodiments, an engineered cell of the invention comprises a variant CD80 of the invention engineered to modulate immunological activity of a T-cell expressing CD28, PD-L1 and/or CTLA-4, or an APC expressing PD-L1, to which the variant CD80 polypeptide specifically binds. In some embodiments, the variant 80 is a transmembrane immunomodulatory protein (hereinafter referred to as "TIP") containing the extracellular domain or a portion thereof containing the IgV domain linked to a transmembrane domain (e.g. a CD80 transmembrane domain) and, optionally, an intracellular signaling domain. In some cases, the TIP is formatted as a chimeric receptor containing a heterologous cytoplasmic signaling domain or endodomain. In some embodiments, an engineered cell is capable of expressing and secreting a immunomodulatory protein as described herein. Among provided engineered cells also are cells further containing an engineered T-cell receptor (TCR) or chimeric antigen receptor (CAR).

The term "engineered T-cell" as used herein refers to a T-cell such as a T helper cell, cytotoxic T-cell (alternatively, cytotoxic T lymphocyte or CTL), natural killer T-cell, regulatory T-cell, memory T-cell, or gamma delta T-cell, that has been genetically modified by human intervention such as by recombinant DNA methods or viral transduction methods. An engineered T-cell comprises a variant CD80 transmembrane immunomodulatory protein (TIP) of the present invention that is expressed on the T-cell and is engineered to modulate immunological activity of the engineered T-cell itself, or a mammalian cell to which the variant CD80 expressed on the T-cell specifically binds.

The term "engineered T-cell receptor" or "engineered TCR" refers to a T-cell receptor (TCR) engineered to specifically bind with a desired affinity to a major histocompatibility complex (MHC)/peptide target antigen that is selected, cloned, and/or subsequently introduced into a population of T-cells, often used for adoptive immunotherapy. In contrast to engineered TCRs, CARs are engineered to bind target antigens in a MHC independent manner.

The term "expressed on" as used herein is used in reference to a protein expressed on the surface of a cell, such as a mammalian cell. Thus, the protein is expressed as a membrane protein. In some embodiments, the expressed protein is a transmembrane protein. In some embodiments, the protein is conjugated to a small molecule moiety such as a drug or detectable label. Proteins expressed on the surface of a cell can include cell-surface proteins such as cell surface receptors that are expressed on mammalian cells.

The term "half-life extending moiety" refers to a moiety of a polypeptide fusion or chemical conjugate that extends the half-life of a protein circulating in mammalian blood serum compared to the half-life of the protein that is not so conjugated to the moiety. In some embodiments, half-life is extended by greater than or greater than about 1.2-fold, 1.5-fold, 2.0-fold, 3.0-fold, 4.0-fold, 5.0-fold, or 6.0-fold. In some embodiments, half-life is extended by more than 6 hours, more than 12 hours, more than 24 hours, more than 48 hours, more than 72 hours, more than 96 hours or more than 1 week after in vivo administration compared to the protein without the half-life extending moiety. The half-life refers to the amount of time it takes for the protein to lose half of its concentration, amount, or activity. Half-life can be determined for example, by using an ELISA assay or an activity assay. Exemplary half-life extending moieties include an Fc domain, a multimerization domain, polyethylene glycol (PEG), hydroxyethyl starch (HES), XTEN (extended recombinant peptides; see, WO2013130683), human serum albumin (HSA), bovine serum albumin (BSA), lipids (acylation), and poly-Pro-Ala-Ser (PAS), and polyglutamic acid (glutamylation).

The term "immunological synapse" or "immune synapse" as used herein means the interface between a mammalian cell that expresses MHC I (major histocompatibility complex) or MHC II, such as an antigen-presenting cell or tumor cell, and a mammalian lymphocyte such as an effector T cell or Natural Killer (NK) cell.

An Fc (fragment crystallizable) region or domain of an immunoglobulin molecule (also termed an Fc polypeptide) corresponds largely to the constant region of the immunoglobulin heavy chain, and is responsible for various functions, including the antibody's effector function(s). The Fc domain contains part or all of a hinge domain of an immunoglobulin molecule plus a CH2 and a CH3 domain. The Fc domain can form a dimer of two polypeptide chains joined by one or more disulfide bonds. In some embodiments, the Fc is a variant Fc that exhibits reduced (e.g. reduced greater than 30%, 40%, 50%, 60%, 70%, 80%, 90% or more) activity to facilitate an effector function. In some embodiments, reference to amino acid substitutions in an Fc region is by EU numbering system unless described with reference to a specific SEQ ID NO. EU numbering is known and is according to the most recently updated IMGT Scientific Chart (IMGT®, the international ImMunoGeneTics information System®, http://www.imgt.org/IMGTScientificChart/Numbering/Hu_IGHGnber.html (created: 17 May 2001, last updated: 10 Jan. 2013) and the EU index as reported in Kabat, E. A. et al. Sequences of Proteins of Immunological interest. 5th ed. US Department of Health and Human Services, NIH publication No. 91-3242 (1991).

An immunoglobulin Fc fusion ("Fc-fusion"), such as an immunomodulatory Fc fusion protein, is a molecule comprising one or more polypeptides (or one or more small molecules) operably linked to an Fc region of an immunoglobulin. An Fc-fusion may comprise, for example, the Fc region of an antibody (which facilitates pharmacokinetics) and a variant CD80 polypeptide. An immunoglobulin Fc region may be linked indirectly or directly to one or more variant CD80 polypeptides or small molecules (fusion partners). Various linkers are known in the art and can optionally be used to link an Fc to a fusion partner to generate an Fc-fusion. Fc-fusions of identical species can be dimerized to form Fc-fusion homodimers, or using non-identical species to form Fc-fusion heterodimers. In some embodiments, the Fc is a mammalian Fc such as a murine or human Fc.

The term "host cell" refers to a cell that can be used to express a protein encoded by a recombinant expression vector. A host cell can be a prokaryote, for example, *E. coli*, or it can be a eukaryote, for example, a single-celled eukaryote (e.g., a yeast or other fungus), a plant cell (e.g., a tobacco or tomato plant cell), an animal cell (e.g., a human cell, a monkey cell, a hamster cell, a rat cell, a mouse cell, or an insect cell) or a hybridoma. Examples of host cells include Chinese hamster ovary (CHO) cells or their derivatives such as Veggie CHO and related cell lines which grow in serum-free media or CHO strain DX-B11, which is deficient in DHFR. In some embodiments, a host cell can be a mammalian cell (e.g., a human cell, a monkey cell, a hamster cell, a rat cell, a mouse cell, or an insect cell).

The term "immunoglobulin" (abbreviated "Ig") as used herein refers to a mammalian immunoglobulin protein including any of the five human classes of antibody: IgA (which includes subclasses IgA1 and IgA2), IgD, IgE, IgG (which includes subclasses IgG1, IgG2, IgG3, and IgG4), and IgM. The term is also inclusive of immunoglobulins that are less than full-length, whether wholly or partially synthetic (e.g., recombinant or chemical synthesis) or naturally produced, such as antigen binding fragment (Fab), variable fragment (Fv) containing $V_H$ and $V_L$, the single chain variable fragment (scFv) containing $V_H$ and $V_L$ linked together in one chain, as well as other antibody V region fragments, such as Fab', $F(ab)_2$, $F(ab')_2$, dsFv diabody, Fc, and Fd polypeptide fragments. Bispecific antibodies, homobispecific and heterobispecific, are included within the meaning of the term.

The term "immunoglobulin superfamily" or "IgSF" as used herein means the group of cell surface and soluble proteins that are involved in the recognition, binding, or adhesion processes of cells. Molecules are categorized as members of this superfamily based on shared structural features with immunoglobulins (i.e., antibodies); they all possess a domain known as an immunoglobulin domain or fold. Members of the IgSF include cell surface antigen receptors, co-receptors and co-stimulatory molecules of the immune system, molecules involved in antigen presentation to lymphocytes, cell adhesion molecules, certain cytokine receptors and intracellular muscle proteins. They are commonly associated with roles in the immune system. Proteins in the immunological synapse are often members of the IgSF. IgSF can also be classified into "subfamilies" based on shared properties such as function. Such subfamilies typically consist of from 4 to 30 IgSF members.

The terms "IgSF domain" or "immunoglobulin domain" or "Ig domain" as used herein refers to a structural domain of IgSF proteins. Ig domains are named after the immunoglobulin molecules. They contain about 70-110 amino acids and are categorized according to their size and function. Ig-domains possess a characteristic Ig-fold, which has a sandwich-like structure formed by two sheets of antiparallel beta strands. Interactions between hydrophobic amino acids on the inner side of the sandwich and highly conserved disulfide bonds formed between cysteine residues in the B and F strands, stabilize the Ig-fold. One end of the Ig domain has a section called the complementarity determining region that is important for the specificity of antibodies for their ligands. The Ig like domains can be classified (into classes) as: IgV, IgC1, IgC2, or IgI. Most Ig domains are either variable (IgV) or constant (IgC). IgV domains with 9 beta strands are generally longer than IgC domains with 7 beta strands. Ig domains of some members of the IgSF resemble IgV domains in the amino acid sequence, yet are similar in size to IgC domains. These are called IgC2 domains, while standard IgC domains are called IgC1 domains. T-cell receptor (TCR) chains contain two Ig domains in the extracellular portion; one IgV domain at the N-terminus and one IgC1 domain adjacent to the cell membrane. CD80 contains two Ig domains: IgV and IgC.

The term "IgSF species" as used herein means an ensemble of IgSF member proteins with identical or substantially identical primary amino acid sequence. Each mammalian immunoglobulin superfamily (IgSF) member defines a unique identity of all IgSF species that belong to that IgSF member. Thus, each IgSF family member is unique from other IgSF family members and, accordingly, each species of a particular IgSF family member is unique from the species of another IgSF family member. Nevertheless, variation between molecules that are of the same IgSF species may occur owing to differences in post-translational modification such as glycosylation, phosphorylation, ubiquitination, nitrosylation, methylation, acetylation, and lipidation. Additionally, minor sequence differences within a single IgSF species owing to gene polymorphisms constitute another form of variation within a single IgSF species as do wild type truncated forms of IgSF species owing to, for example, proteolytic cleavage. A "cell surface IgSF species" is an IgSF species expressed on the surface of a cell, generally a mammalian cell.

The term "immunological activity" as used herein in the context of mammalian lymphocytes such as T-cells refers to one or more cell survival, cell proliferation, cytokine production (e.g. interferon-gamma), or T-cell cytotoxicity activities. In some cases, an immunological activity can means their expression of cytokines, such as chemokines or interleukins. Assays for determining enhancement or suppression of immunological activity include the MLR (mixed lymphocyte reaction) assays measuring interferon-gamma cytokine levels in culture supernatants (Wang et al., Cancer Immunol Res. 2014 September: 2(9):846-56), SEB (staphylococcal enterotoxin B) T cell stimulation assay (Wang et al., Cancer Immunol Res. 2014 September: 2(9):846-56), and anti-CD3 T cell stimulation assays (Li and Kurlander, J Transl Med. 2010: 8: 104). Since T cell activation is associated with secretion of IFN-gamma cytokine, detecting IFN-gamma levels in culture supernatants from these in vitro human T cell assays can be assayed using commercial ELISA kits (Wu et al, Immunol Lett 2008 Apr. 15; 117(1): 57-62). Induction of an immune response results in an increase in immunological activity relative to quiescent lymphocytes. An immunomodulatory protein, such as a variant CD80 polypeptide containing an affinity modified IgSF domain, as provided herein can in some embodiments increase or, in alternative embodiments, decrease IFN-gamma (interferon-gamma) expression in a primary T-cell assay relative to a wild-type IgSF member or IgSF domain control. Those of skill will recognize that the format of the primary T-cell assay used to determine an increase in IFN-gamma expression will differ from that employed to assay for a decrease in IFN-gamma expression. In assaying for the ability of an immunomodulatory protein or affinity modified IgSF domain of the invention to decrease IFN-gamma expression in a primary T-cell assay, a Mixed Lymphocyte Reaction (MLR) assay can be used as described in Example 6. Conveniently, a soluble form of an affinity modified IgSF domain of the invention can be employed to determine its ability to antagonize and thereby decrease the IFN-gamma expression in a MLR as likewise described in Example 6. Alternatively, in assaying for the ability of an immunomodulatory protein or affinity modified IgSF domain of the invention to increase IFN-gamma expression in a primary T-cell assay, a co-immobilization assay can be used. In a co-immobilization assay, a T-cell receptor signal, provided in some embodiments by anti-CD3 antibody, is used in conjunction with a co-immobilized affinity modified IgSF domain, such as a variant CD80, to determine the ability to increase IFN-gamma expression relative to a wild-type IgSF domain control. Methods to assay the immunological activity of engineered cells, including to evaluate the activity of a variant CD80 transmembrane immunomodulatory protein, are known in the art and include, but are not limited to, the ability to expand T cells following antigen stimulation, sustain T cell expansion in the absence of re-stimulation, and anti-cancer activities in appropriate animal models. Assays also include assays to assess cytotoxicity, including a standard $^{51}$Cr-release assay (see e.g. Milone et al., (2009) Molecular Therapy 17: 1453-1464) or flow based cytotoxicity assays, or an impedance based cytotoxicity assay (Peper et al. (2014) Journal of Immunological Methods, 405:192-198).

An "immunomodulatory polypeptide" is a polypeptide that modulates immunological activity. By "modulation" or "modulating" an immune response is meant that immunological activity is either increased or decreased. An immunomodulatory polypeptide can be a single polypeptide chain or a multimer (dimers or higher order multimers) of at least two polypeptide chains covalently bonded to each other by, for example, interchain disulfide bonds. Thus, monomeric, dimeric, and higher order multimeric polypeptides are within the scope of the defined term. Multimeric polypeptides can be homomultimeric (of identical polypeptide chains) or heteromultimeric (of non-identical polypeptide chains). An immunomodulatory polypeptide can comprise variant CD80.

The term "increase" as used herein means to increase by a statistically significant amount. An increase can be at least 5%, 10%, 20%, 30%, 40%, 50%, 75%, 100%, or greater than a non-zero control value.

An "isoform" of CD80 is one of a plurality of naturally occurring CD80 polypeptides that differ in amino acid sequence. Isoforms can be the product of splice variants of an RNA transcript expressed by a single gene, or the expression product of highly similar but different genes yielding a functionally similar protein such as may occur from gene duplication. As used herein, the term "isoform" of CD80 also refers to the product of different alleles of a CD80 gene.

The term "lymphocyte" as used herein means any of three subtypes of white blood cell in a mammalian immune system. They include natural killer cells (NK cells) (which function in cell-mediated, cytotoxic innate immunity), T cells (for cell-mediated, cytotoxic adaptive immunity), and B cells (for humoral, antibody-driven adaptive immunity). T cells include: T helper cells, cytotoxic T-cells, natural killer T-cells, memory T-cells, regulatory T-cells, or gamma delta T-cells. Innate lymphoid cells (ILC) are also included within the definition of lymphocyte.

The terms "mammal," or "patient" specifically includes reference to at least one of a: human, chimpanzee, rhesus monkey, cynomolgus monkey, dog, cat, mouse, or rat.

The term "membrane protein" as used herein means a protein that, under physiological conditions, is attached directly or indirectly to a lipid bilayer. A lipid bilayer that forms a membrane can be a biological membrane such as a eukaryotic (e.g., mammalian) cell membrane or an artificial (i.e., man-made) membrane such as that found on a liposome. Attachment of a membrane protein to the lipid bilayer can be by way of covalent attachment, or by way of non-covalent interactions such as hydrophobic or electrostatic interactions. A membrane protein can be an integral membrane protein or a peripheral membrane protein. Membrane proteins that are peripheral membrane proteins are non-covalently attached to the lipid bilayer or non-covalently attached to an integral membrane protein. A peripheral membrane protein forms a temporary attachment to the lipid bilayer such that under the range of conditions that are physiological in a mammal, peripheral membrane protein can associate and/or disassociate from the lipid bilayer. In contrast to peripheral membrane proteins, integral membrane proteins form a substantially permanent attachment to the membrane's lipid bilayer such that under the range of conditions that are physiological in a mammal, integral membrane proteins do not disassociate from their attachment to the lipid bilayer. A membrane protein can form an attachment to the membrane by way of one layer of the lipid bilayer (monotopic), or attached by way of both layers of the membrane (polytopic). An integral membrane protein that interacts with only one lipid bilayer is an "integral monotopic protein". An integral membrane protein that interacts with both lipid bilayers is an "integral polytopic protein" alternatively referred to herein as a "transmembrane protein".

The terms "modulating" or "modulate" as used herein in the context of an immune response, such as a mammalian immune response, refer to any alteration, such as an increase or a decrease, of existing or potential immune responses that occurs as a result of administration of an immunomodulatory polypeptide comprising a variant CD80 of the present invention or as a result of administration of engineered cells expresses an immunomodulatory protein, such as a variant CD80 transmembrane immunomodulatory protein of the present invention. Thus, it refers to an alteration, such as an increase or decrease, of an immune response as compared to the immune response that occurs or is present in the absence of the administration of the immunomodulatory protein comprising the variant CD80. Such modulation includes any induction, activation, suppression or alteration in degree or extent of immunological activity of an immune cell. Immune cells include B cells, T cells, NK (natural killer) cells, NK T cells, professional antigen-presenting cells (APCs), and non-professional antigen-presenting cells, and inflammatory cells (neutrophils, macrophages, monocytes, eosinophils, and basophils). Modulation includes any change imparted on an existing immune response, a developing immune response, a potential immune response, or the capacity to induce, regulate, influence, or respond to an immune response. Modulation includes any alteration in the expression and/or function of genes, proteins and/or other molecules in immune cells as part of an immune response. Modulation of an immune response or modulation of immunological activity includes, for example, the following: elimination, deletion, or sequestration of immune cells; induction or generation of immune cells that can modulate the functional capacity of other cells such as autoreactive lymphocytes, antigen presenting cells, or inflammatory cells; induction of an unresponsive state in immune cells (i.e., anergy); enhancing or suppressing the activity or function of immune cells, including but not limited to altering the pattern of proteins expressed by these cells. Examples include altered production and/or secretion of certain classes of molecules such as cytokines, chemokines, growth factors, transcription factors, kinases, costimulatory molecules, or other cell surface receptors or any combination of these modulatory events. Modulation can be assessed, for example, by an alteration in IFN-gamma (interferon gamma) expression relative to the wild-type or unmodified CD80 control in a primary T cell assay (see, Zhao and Ji, Exp Cell Res. 2016 Jan. 1; 340(1) 132-138).

Modulation can be assessed, for example, by an alteration of an immunological activity of engineered cells, such as an alteration in in cytotoxic activity of engineered cells or an alteration in cytokine secretion of engineered cells relative to cells engineered with a wild-type CD80 transmembrane protein.

The term, a "multimerization domain" refers to a sequence of amino acids that promotes stable interaction of a polypeptide molecule with one or more additional polypeptide molecules, each containing a complementary multimerization domain, which can be the same or a different multimerization domain to form a stable multimer with the first domain. Generally, a polypeptide is joined directly or indirectly to the multimerization domain. Exemplary multimerization domains include the immunoglobulin sequences or portions thereof, leucine zippers, hydrophobic regions, hydrophilic regions, and compatible protein-protein interaction domains. The multimerization domain, for example, can be an immunoglobulin constant region or domain, such as, for example, the Fc domain or portions thereof from IgG, including IgG1, IgG2, IgG3 or IgG4 subtypes, IgA, IgE, IgD and IgM and modified forms thereof.

The terms "nucleic acid" and "polynucleotide" are used interchangeably to refer to a polymer of nucleic acid residues (e.g., deoxyribonucleotides or ribonucleotides) in either single- or double-stranded form. Unless specifically limited, the terms encompass nucleic acids containing known analogues of natural nucleotides and that have similar binding properties to it and are metabolized in a manner similar to naturally-occurring nucleotides. Unless otherwise indicated, a particular nucleic acid sequence also implicitly encompasses conservatively modified variants thereof (e.g., degenerate codon substitutions) and complementary nucleotide sequences as well as the sequence explicitly indicated (a "reference sequence"). Specifically, degenerate codon substitutions may be achieved by generating sequences in which the third position of one or more selected (or all) codons is substituted with mixed-base and/or deoxyinosine residues. The term nucleic acid or polynucleotide encompasses cDNA or mRNA encoded by a gene.

The term "molecular species" as used herein means an ensemble of proteins with identical or substantially identical primary amino acid sequence. Each mammalian immunoglobulin superfamily (IgSF) member defines a collection of identical or substantially identical molecular species. Thus, for example, human CD80 is an IgSF member and each human CD80 molecule is a molecular species of CD80. Variation between molecules that are of the same molecular species may occur owing to differences in post-translational modification such as glycosylation, phosphorylation, ubiquitination, nitrosylation, methylation, acetylation, and lipidation. Additionally, minor sequence differences within a single molecular species owing to gene polymorphisms constitute another form of variation within a single molecular species as do wild type truncated forms of a single molecular species owing to, for example, proteolytic cleavage. A "cell surface molecular species" is a molecular species expressed on the surface of a mammalian cell. Two or more different species of protein, each of which is present exclusively on one or exclusively the other (but not both) of the two mammalian cells forming the IS, are said to be in "cis" or "cis configuration" with each other. Two different species of protein, the first of which is exclusively present on one of the two mammalian cells forming the IS and the second of which is present exclusively on the second of the two mammalian cells forming the IS, are said to be in "trans" or "trans configuration." Two different species of protein each of which is present on both of the two mammalian cells forming the IS are in both cis and trans configurations on these cells.

The term "non-competitive binding" as used herein means the ability of a protein to specifically bind simultaneously to at least two cognate binding partners. Thus, the protein is able to bind to at least two different cognate binding partners at the same time, although the binding interaction need not be for the same duration such that, in some cases, the protein is specifically bound to only one of the cognate binding partners. In some embodiments, the binding occurs under specific binding conditions. In some embodiments, the simultaneous binding is such that binding of one cognate binding partner does not substantially inhibit simultaneous binding to a second cognate binding partner. In some embodiments, non-competitive binding means that binding a second cognate binding partner to its binding site on the protein does not displace the binding of a first cognate binding partner to its binding site on the protein. Methods of assessing non-competitive binding are well known in the art such as the method described in Perez de La Lastra et al., Immunology, 1999 April: 96(4): 663-670. In some cases, in non-competitive interactions, the first cognate binding partner specifically binds at an interaction site that does not overlap with the interaction site of the second cognate binding partner such that binding of the second cognate binding partner does not directly interfere with the binding of the first cognate binding partner. Thus, any effect on binding of the cognate binding partner by the binding of the second cognate binding partner is through a mechanism other than direct interference with the binding of the first cognate binding partner. For example, in the context of enzyme-substrate interactions, a non-competitive inhibitor binds to a site other than the active site of the enzyme. Non-competitive binding encompasses uncompetitive binding interactions in which a second cognate binding partner specifically binds at an interaction site that does not overlap with the binding of the first cognate binding partner but binds to the second interaction site only when the first interaction site is occupied by the first cognate binding partner.

The term "pharmaceutical composition" refers to a composition suitable for pharmaceutical use in a mammalian subject, often a human. A pharmaceutical composition typically comprises an effective amount of an active agent (e.g., an immunomodulatory polypeptide comprising a variant CD80 or engineered cells expressing a variant CD80 transmembrane immunomodulatory protein) and a carrier, excipient, or diluent. The carrier, excipient, or diluent is typically a pharmaceutically acceptable carrier, excipient or diluent, respectively.

The terms "polypeptide" and "protein" are used interchangeably herein and refer to a molecular chain of two or more amino acids linked through peptide bonds. The terms do not refer to a specific length of the product. Thus, "peptides," and "oligopeptides," are included within the definition of polypeptide. The terms include post-translational modifications of the polypeptide, for example, glycosylation, acetylation, phosphorylation and the like. The terms also include molecules in which one or more amino acid analogs or non-canonical or unnatural amino acids that can be synthesized, or expressed recombinantly using known protein engineering techniques. In addition, proteins can be derivatized.

The term "primary T-cell assay" as used herein refers to an in vitro assay to measure interferon-gamma ("IFN-gamma") expression. A variety of such primary T-cell assays are known in the art such as that described in Example 6. In a preferred embodiment, the assay used is anti-CD3 coimmobilization assay. In this assay, primary T cells are stimulated by anti-CD3 immobilized with or without additional recombinant proteins. Culture supernatants are harvested at timepoints, usually 24-72 hours. In another embodiment, the assay used is a mixed lymphocyte reaction (MLR). In this assay, primary T cells are simulated with allogenic APC. Culture supernatants are harvested at timepoints, usually 24-72 hours. Human IFN-gamma levels are measured in culture supernatants by standard ELISA techniques. Commercial kits are available from vendors and the assay is performed according to manufacturer's recommendation.

The term "purified" as applied to nucleic acids, such as encoding immunomodulatory proteins of the invention, generally denotes a nucleic acid or polypeptide that is substantially free from other components as determined by analytical techniques well known in the art (e.g., a purified polypeptide or polynucleotide forms a discrete band in an electrophoretic gel, chromatographic eluate, and/or a media subjected to density gradient centrifugation). For example, a nucleic acid or polypeptide that gives rise to essentially one band in an electrophoretic gel is "purified." A purified nucleic acid or protein of the invention is at least about 50% pure, usually at least about 75%, 80%, 85%, 90%, 95%, 96%, 99% or more pure (e.g., percent by weight or on a molar basis).

The term "recombinant" indicates that the material (e.g., a nucleic acid or a polypeptide) has been artificially (i.e., non-naturally) altered by human intervention. The alteration can be performed on the material within, or removed from, its natural environment or state. For example, a "recombinant nucleic acid" is one that is made by recombining nucleic acids, e.g., during cloning, affinity modification, DNA shuffling or other well-known molecular biological procedures. A "recombinant DNA molecule," is comprised of segments of DNA joined together by means of such molecular biological techniques. The term "recombinant protein" or "recombinant polypeptide" as used herein refers to a protein molecule which is expressed using a recombinant DNA molecule. A "recombinant host cell" is a cell that contains and/or expresses a recombinant nucleic acid or that is otherwise altered by genetic engineering, such as by introducing into the cell a nucleic acid molecule encoding a recombinant protein, such as a transmembrane immunomodulatory protein provided herein. Transcriptional control signals in eukaryotes comprise "promoter" and "enhancer" elements. Promoters and enhancers consist of short arrays of DNA sequences that interact specifically with cellular proteins involved in transcription. Promoter and enhancer elements have been isolated from a variety of eukaryotic sources including genes in yeast, insect and mammalian cells and viruses (analogous control elements, i.e., promoters, are also found in prokaryotes). The selection of a particular promoter and enhancer depends on what cell type is to be used to express the protein of interest. The terms "in operable combination," "in operable order" and "operably linked" as used herein refer to the linkage of nucleic acid sequences in such a manner or orientation that a nucleic acid molecule capable of directing the transcription of a given gene and/or the synthesis of a desired protein molecule is produced.

The term "recombinant expression vector" as used herein refers to a DNA molecule containing a desired coding sequence and appropriate nucleic acid sequences necessary for the expression of the operably linked coding sequence in a particular host cell. Nucleic acid sequences necessary for expression in prokaryotes include a promoter, optionally an operator sequence, a ribosome binding site and possibly other sequences. Eukaryotic cells are known to utilize promoters, enhancers, and termination and polyadenylation signals. A secretory signal peptide sequence can also, optionally, be encoded by the recombinant expression vector, operably linked to the coding sequence for the recombinant protein, such as a recombinant fusion protein, so that the expressed fusion protein can be secreted by the recombinant host cell, for easier isolation of the fusion protein from the cell, if desired. The term includes the vector as a self-replicating nucleic acid structure as well as the vector incorporated into the genome of a host cell into which it has been introduced. Among the vectors are viral vectors, such as lentiviral vectors.

The term "selectivity" refers to the preference of a subject protein, or polypeptide, for specific binding of one substrate, such as one cognate binding partner, compared to specific binding for another substrate, such as a different cognate binding partner of the subject protein. Selectivity can be reflected as a ratio of the binding activity (e.g. binding affinity) of a subject protein and a first substrate, such as a first cognate binding partner, (e.g., $K_{d1}$) and the binding activity (e.g. binding affinity) of the same subject protein with a second cognate binding partner (e.g., $K_{d2}$).

The term "sequence identity" as used herein refers to the sequence identity between genes or proteins at the nucleotide or amino acid level, respectively. "Sequence identity" is a measure of identity between proteins at the amino acid level and a measure of identity between nucleic acids at nucleotide level. The protein sequence identity may be determined by comparing the amino acid sequence in a given position in each sequence when the sequences are aligned. Similarly, the nucleic acid sequence identity may be determined by comparing the nucleotide sequence in a given position in each sequence when the sequences are aligned. Methods for the alignment of sequences for comparison are well known in the art, such methods include GAP, BESTFIT, BLAST, FASTA and TFASTA. The BLAST algorithm calculates percent sequence identity and performs a statistical analysis of the similarity between the two sequences. The software for performing BLAST analysis is publicly available through the National Center for Biotechnology Information (NCBI) website.

The term "soluble" as used herein in reference to proteins, means that the protein is not a membrane protein. In general, a soluble protein contains only the extracellular domain of an IgSF family member receptor, or a portion thereof containing an IgSF domain or domains or specific-binding fragments thereof, but does not contain the transmembrane domain. In some cases, solubility of a protein can be improved by linkage or attachment, directly or indirectly via a linker, to an Fc domain, which, in some cases, also can improve the stability and/or half-life of the protein. In some aspects, a soluble protein is an Fc fusion protein.

The term "species" as used herein with respect to polypeptides or nucleic acids means an ensemble of molecules with identical or substantially identical sequences. Variation between polypeptides that are of the same species may occur owing to differences in post-translational modification such as glycosylation, phosphorylation, ubiquitination, nitrosylation, methylation, acetylation, and lipidation. Slightly truncated sequences of polypeptides that differ (or encode a difference) from the full length species at the amino-terminus or carboxyl-terminus by no more than 1, 2 or 3 amino acid residues are considered to be of a single species. Such microheterogeneities are a common feature of manufactured proteins.

The term “specific binding fragment” as used herein in reference to a full-length wild-type mammalian CD80 polypeptide or an IgV or an IgC domain thereof, means a polypeptide having a subsequence of an IgV and/or IgC domain and that specifically binds in vitro and/or in vivo to a mammalian CD28, mammalian PD-L1 and/or mammalian CTLA-4, such as a human or murine CD28, PD-L1, and/or CTLA-4. In some embodiments, the specific binding fragment of the CD80 IgV or the CD80 IgC is at least 60%, 70%, 75%, 80%, 85%, 90%, 95%, 96%, 97%, 98%, or 99% the sequence length of the full-length wild-type sequence. The specific binding fragment can be altered in sequence to form the variant CD80.

The term “specifically binds” as used herein means the ability of a protein, under specific binding conditions, to bind to a target protein such that its affinity or avidity is at least 5 times as great, but optionally at least 10, 20, 30, 40, 50, 100, 250 or 500 times as great, or even at least 1000 times as great as the average affinity or avidity of the same protein to a collection of random peptides or polypeptides of sufficient statistical size. A specifically binding protein need not bind exclusively to a single target molecule but may specifically bind to a non-target molecule due to similarity in structural conformation between the target and non-target (e.g., paralogs or orthologs). Those of skill will recognize that specific binding to a molecule having the same function in a different species of animal (i.e., ortholog) or to a non-target molecule having a substantially similar epitope as the target molecule (e.g., paralog) is possible and does not detract from the specificity of binding which is determined relative to a statistically valid collection of unique non-targets (e.g., random polypeptides). Thus, a polypeptide of the invention may specifically bind to more than one distinct species of target molecule due to cross-reactivity. Solid-phase ELISA immunoassays or Biacore measurements can be used to determine specific binding between two proteins. Generally, interactions between two binding proteins have dissociation constants ($K_d$) less than $1\times10^{-5}$ M, and often as low as $1\times10^{-12}$ M. In certain embodiments of the present disclosure, interactions between two binding proteins have dissociation constants of $1\times10^{-6}$ M, $1\times10^{-7}$ M, $1\times10^{-8}$ M, $1\times10^{-9}$ M, $1\times10^{-10}$ M or $1\times10^{-11}$ M.

The terms “surface expresses” or “surface expression” in reference to a mammalian cell expressing a polypeptide means that the polypeptide is expressed as a membrane protein. In some embodiments, the membrane protein is a transmembrane protein.

As used herein, “synthetic,” with reference to, for example, a synthetic nucleic acid molecule or a synthetic gene or a synthetic peptide refers to a nucleic acid molecule or polypeptide molecule that is produced by recombinant methods and/or by chemical synthesis methods.

The term “targeting moiety” as used herein refers to a composition that is covalently or non-covalently attached to, or physically encapsulates, a polypeptide comprising the variant CD80. The targeting moiety has specific binding affinity for a desired counter-structure such as a cell surface receptor (e.g., the B7 family member PD-L1), or a tumor antigen such as tumor specific antigen (TSA) or a tumor associated antigen (TAA) such as B7-H6. Typically, the desired counter-structure is localized on a specific tissue or cell-type. Targeting moieties include: antibodies, antigen binding fragment (Fab), variable fragment (Fv) containing $V_H$ and $V_L$, the single chain variable fragment (scFv) containing $V_H$ and $V_L$ linked together in one chain, as well as other antibody V region fragments, such as Fab', $F(ab)_2$, $F(ab')_2$, dsFv diabody, nanobodies, soluble receptors, receptor ligands, affinity matured receptors or ligands, as well as small molecule (<500 dalton) compositions (e.g., specific binding receptor compositions). Targeting moieties can also be attached covalently or non-covalently to the lipid membrane of liposomes that encapsulate a polypeptide of the present invention.

The term “transmembrane protein” as used herein means a membrane protein that substantially or completely spans a lipid bilayer such as those lipid bilayers found in a biological membrane such as a mammalian cell, or in an artificial construct such as a liposome. The transmembrane protein comprises a transmembrane domain (“transmembrane domain”) by which it is integrated into the lipid bilayer and by which the integration is thermodynamically stable under physiological conditions. Transmembrane domains are generally predictable from their amino acid sequence via any number of commercially available bioinformatics software applications on the basis of their elevated hydrophobicity relative to regions of the protein that interact with aqueous environments (e.g., cytosol, extracellular fluid). A transmembrane domain is often a hydrophobic alpha helix that spans the membrane. A transmembrane protein can pass through the both layers of the lipid bilayer once or multiple times. A transmembrane protein includes the provided transmembrane immunomodulatory proteins described herein. In addition to the transmembrane domain, a transmembrane immunomodulatory protein of the invention further comprises an ectodomain and, in some embodiments, an endodomain.

The terms “treating,” “treatment,” or “therapy” of a disease or disorder as used herein mean slowing, stopping or reversing the disease or disorders progression, as evidenced by decreasing, cessation or elimination of either clinical or diagnostic symptoms, by administration of a therapeutic composition (e.g. containing an immunomodulatory protein or engineered cells) of the invention either alone or in combination with another compound as described herein. “Treating,” “treatment,” or “therapy” also means a decrease in the severity of symptoms in an acute or chronic disease or disorder or a decrease in the relapse rate as for example in the case of a relapsing or remitting autoimmune disease course or a decrease in inflammation in the case of an inflammatory aspect of an autoimmune disease. As used herein in the context of cancer, the terms “treatment” or, “inhibit,” “inhibiting” or “inhibition” of cancer refers to at least one of: a statistically significant decrease in the rate of tumor growth, a cessation of tumor growth, or a reduction in the size, mass, metabolic activity, or volume of the tumor, as measured by standard criteria such as, but not limited to, the Response Evaluation Criteria for Solid Tumors (RECIST), or a statistically significant increase in progression free survival (PFS) or overall survival (OS). “Preventing,” “prophylaxis,” or “prevention” of a disease or disorder as used in the context of this invention refers to the administration of an immunomodulatory polypeptide or engineered cells of the invention, either alone or in combination with another compound, to prevent the occurrence or onset of a disease or disorder or some or all of the symptoms of a disease or disorder or to lessen the likelihood of the onset of a disease or disorder.

The term “tumor specific antigen” or “TSA” as used herein refers to a counter-structure that is present primarily on tumor cells of a mammalian subject but generally not found on normal cells of the mammalian subject. A tumor specific antigen need not be exclusive to tumor cells but the percentage of cells of a particular mammal that have the tumor specific antigen is sufficiently high or the levels of the tumor specific antigen on the surface of the tumor are sufficiently high such that it can be targeted by anti-tumor therapeutics, such as immunomodulatory polypeptides of the invention, and provide prevention or treatment of the mammal from the effects of the tumor. In some embodiments, in a random statistical sample of cells from a mammal with a tumor, at least 50% of the cells displaying a TSA are cancerous. In other embodiments, at least 60%, 70%, 80%, 85%, 90%, 95%, or 99% of the cells displaying a TSA are cancerous.

The term "variant" (also "modified" or mutant") as used in reference to a variant CD80 means a CD80, such as a mammalian (e.g., human or murine) CD80 created by human intervention. The variant CD80 is a polypeptide having an altered amino acid sequence, relative to an unmodified or wild-type CD80. The variant CD80 is a polypeptide which differs from a wild-type CD80 isoform sequence by one or more amino acid substitutions, deletions, additions, or combinations thereof. For purposes herein, the variant CD80 contains at least one affinity modified domain, whereby one or more of the amino acid differences occurs in an IgSF domain (e.g. IgV domain). A variant CD80 can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions. A variant CD80 polypeptide generally exhibits at least 50%, 60%, 70%, 80%, 85%, 86%, 87%, 88%, 89%, 90%, 91%, 92%, 93%, 94%, 95%, 96%, 97%, 98%, 99% or more sequence identity to a corresponding wild-type or unmodified CD80, such as to the sequence of SEQ ID NO: 1, a mature sequence thereof or a portion thereof containing the extracellular domain or an IgSF domain thereof. In some embodiments, a variant CD80 polypeptide exhibits at least 50%, 60%, 70%, 80%, 85%, 86%, 87%, 88%, 89%, 90%, 91%, 92%, 93%, 94%, 95%, 96%, 97%, 98%, 99% or more sequence identity to a corresponding wild-type or unmodified CD80 comprising the sequence set forth in SEQ ID NO:28, SEQ ID NO: 152, or SEQ ID NO:372. Non-naturally occurring amino acids as well as naturally occurring amino acids are included within the scope of permissible substitutions or additions. A variant CD80 is not limited to any particular method of making and includes, for example, de novo chemical synthesis, de novo recombinant DNA techniques, or combinations thereof. A variant CD80 of the invention specifically binds to at least one or more of: CD28, PD-L1 and/or CTLA-4 of a mammalian species. In some embodiments, the altered amino acid sequence results in an an altered (i.e., increased or decreased) binding affinity or avidity to CD28, PD-L1 and/or CTLA-4 compared to the unmodified or wild-type CD80 protein. An increase or decrease in binding affinity or avidity can be determined using well known binding assays such as flow cytometry. Larsen et al., American Journal of Transplantation, Vol 5: 443-453 (2005). See also, Linsley et al., Immunity, 1: 7930801 (1994). An increase in variant CD80 binding affinity or avidity to CD28, PD-L1 and/or CTLA-4 can be a value at least 5% greater than that of the unmodified or wild-type CD80 and in some embodiments, at least 10%, 15%, 20%, 30%, 40%, 50%, 100% greater than that of the unmodified or wild-type CD80 control value. A decrease in CD80 binding affinity or avidity to CD28, PD-L1 and/or CTLA-4 is to a value no greater than 95% of the of the unmodified or wild-type CD80 control values, and in some embodiments no greater than 80%, 70% 60%, 50%, 40%, 30%, 20%, 10%, 5%, or no detectable binding affinity or avidity of the unmodified or wild-type CD80 control values. A variant CD80 polypeptide is altered in primary amino acid sequence by substitution, addition, or deletion of amino acid residues. The term "variant" in the context of variant CD80 polypeptide is not be construed as imposing any condition for any particular starting composition or method by which the variant CD80 is created. A variant CD80 can, for example, be generated starting from wild type mammalian CD80 sequence information, then modeled in silico for binding to CD28, PD-L1 and/or CTLA-4, and finally recombinantly or chemically synthesized to yield the variant CD80. In but one alternative example, the variant CD80 can be created by site-directed mutagenesis of an unmodified or wild-type CD80. Thus, variant CD80 denotes a composition and not necessarily a product produced by any given process. A variety of techniques including recombinant methods, chemical synthesis, or combinations thereof, may be employed.

The term "wild-type" or "natural" or "native" as used herein is used in connection with biological materials such as nucleic acid molecules, proteins (e.g., CD80), IgSF members, host cells, and the like, refers to those which are found in nature and not modified by human intervention.

II. VARIANT CD80 POLYPEPTIDES

Provided herein are variant CD80 polypeptides that exhibit altered (increased or decreased) binding activity or affinity for one or more CD80 cognate binding partners. In some embodiments, the CD80 cognate binding partner is CD28, PD-L1, or CTLA-4. In some embodiments, the variant CD80 polypeptide contains one or more amino acid modifications, such as one or more substitutions (alternatively, "mutations" or "replacements"), deletions or additions in an immunoglobulin superfamily (IgSF) domain (IgD) relative to a wild-type or unmodified CD80 polypeptide or a portion of a wild-type or unmodified CD80 containing the IgD or a specific binding fragment thereof.

Thus, a provided variant CD80 polypeptide is or comprises a variant IgD (hereinafter called "vIgD") in which the one or more amino acid modifications (e.g., substitutions) is in an IgD.

In some embodiments, the IgD comprises an IgV domain or an IgC (e.g. IgC2) domain or specific binding fragment of the IgV domain or the IgC (e.g. IgC2) domain, or combinations thereof. In some embodiments, the IgD can be an IgV only, the combination of the IgV and IgC, including the entire extracellular domain (ECD), or any combination of Ig domains of CD80. Table 2 provides exemplary residues that correspond to IgV or IgC regions of CD80. In some embodiments, the variant CD80 polypeptide contains an IgV domain, or an IgC domain, or specific binding fragments thereof in which the at least one amino acid modification (e.g., substitution) in the IgV domain or IgC domain or the specific binding fragment thereof. In some embodiments, the variant CD80 polypeptide contains an IgV domain or specific binding fragments thereof in which the at least one of the amino acid modifications (e.g., substitutions) is in the IgV domain or a specific binding fragment thereof. In some embodiments, by virtue of the altered binding activity or affinity, the altered IgV domain or IgC domain is an affinity modified IgSF domain.

In some embodiments, the variant is modified in one more IgSF domains relative to the sequence of an unmodified CD80 sequence. In some embodiments, the unmodified CD80 sequence is a wild-type CD80. In some embodiments, the unmodified or wild-type CD80 has the sequence of a native CD80 or an ortholog thereof. In some embodiments, the unmodified CD80 is or comprises the extracellular domain (ECD) of CD80 or a portion thereof containing one or more IgSF domain (see Table 2). In some embodiments, the extracellular domain of an unmodified or wild-type CD80 polypeptide comprises an IgV domain and an IgC domain or domains. However, the variant CD80 polypeptide need not comprise both the IgV domain and the IgC domain or domains. In some embodiments, the variant CD80 polypeptide comprises or consists essentially of the IgV domain or a specific binding fragment thereof. In some embodiments, the variant CD80 polypeptide comprises or consists essentially of the IgC domain or specific binding fragments thereof. In some embodiments, the variant CD80 is soluble and lacks a transmembrane domain. In some embodiments, the variant CD80 further comprises a transmembrane domain and, in some cases, also a cytoplasmic domain.

In some embodiments, the wild-type or unmodified CD80 polypeptide is a mammalian CD80 polypeptide, such as, but not limited to, a human, a mouse, a cynomolgus monkey, or a rat CD80 polypeptide. In some embodiments, the wild-type or unmodified CD80 sequence is human.

In some embodiments, the wild-type or unmodified CD80 polypeptide has (i) the sequence of amino acids set forth in SEQ ID NO: 1 or a mature form thereof lacking the signal sequence, (ii) a sequence of amino acids that exhibits at least about 85%, 86%, 87%, 88%, 89%, 90%, 91%, 92%, 93%, 94%, 95%, 96%, 97%, 98%, 99% sequence identity to SEQ ID NO: 1 or a mature form thereof, or (iii) is a portion of (i) or (ii) containing an IgV domain or IgC domain or specific binding fragments thereof.

In some embodiments, the wild-type or unmodified CD80 polypeptide is or comprises an extracellular domain of the CD80 or a portion thereof. For example, in some embodiments, the unmodified or wild-type CD80 polypeptide comprises the amino acid sequence set forth in SEQ ID NO: 28, or an ortholog thereof. For example, the unmodified or wild-type CD80 polypeptide can comprise (i) the sequence of amino acids set forth in SEQ ID NO:28, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 28, or (iii) is a specific binding fragment of of (i) or (ii) comprising an IgV domain or an IgC domain. In some embodiments, the wild-type or unmodified extracellular domain of CD80 is capable of binding one or more CD80 cognate binding proteins, such as one or more of CD28, PD-L1 or CTLA-4.

In some embodiments, the wild-type or unmodified CD80 polypeptide contains an IgV domain or an IgC domain, or a specific binding fragment thereof. In some embodiments, the IgV domain of the wild-type or unmodified CD80 polypeptide comprises the amino acid sequence set forth in SEQ ID NO: 152 or 372, or an ortholog thereof. For example, the IgV domain of the unmodified or wild-type CD80 polypeptide can contain (i) the sequence of amino acids set forth in SEQ ID NO: 152 or 372, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 152 or 372, or (iii) is a specific binding fragment of (i) or (ii). In some embodiments, the wild-type or unmodified IgV domain is capable of binding one or more CD80 cognate binding proteins, such as one or more of CD28, PD-L1 or CTLA-4.

In some embodiments, the IgC domain of the wild-type or unmodified CD80 polypeptide comprises the amino acid sequence set forth as residues 145-230 or 154-232 of SEQ ID NO: 1, or an ortholog thereof. For example, the IgC domain of the unmodified or wild-type CD80 polypeptide can contain (i) the sequence of amino acids set forth residues 145-230 or 154-232 of SEQ ID NO: 1, (ii) a sequence of amino acids that has at least about 85%, 86%, 87%, 88%, 89%, 90%, 91%, 92%, 93%, 94%, 95%, 96%, 97%, 98%, 99% sequence identity to residues 145-230 or 154-232 of SEQ ID NO: 1, or (iii) is a specific binding fragment of (i) or (ii). In some embodiments, the wild-type or unmodified IgC domain is capable of binding one or more CD80 cognate binding proteins.

In some embodiments, the wild-type or unmodified CD80 polypeptide contains a specific binding fragment of CD80, such as a specific binding fragment of the IgV domain or the IgC domain. In some embodiments the specific binding fragment can bind CD28, PD-L1, and/or CTLA-4. The specific binding fragment can have an amino acid length of at least 50 amino acids, such as at least 60, 70, 80, 90, 100, or 110 amino acids. In some embodiments, the specific binding fragment of the IgV domain contains an amino acid sequence that is at least about 85%, 86%, 87%, 88%, 89%, 90%, 91%, 92%, 93%, 94%, 95%, 96%, 97%, 98%, 99% of the length of the IgV domain set forth as amino acids 35-135 or 37-138 of SEQ ID NO: 1. In some embodiments, the specific binding fragment of the IgC domain comprises an amino acid sequence that is at least about 85%, 86%, 87%, 88%, 89%, 90%, 91%, 92%, 93%, 94%, 95%, 96%, 97%, 98%, 99% of the length of the IgC domain set forth as amino acids 145-230 or 154-232 of SEQ ID NO: 1.

In some embodiments, the variant CD80 polypeptide comprises the ECD domain or a portion thereof comprising one or more affinity modified IgSF domains. In some embodiments, the variant CD80 polypeptides can comprise an IgV domain or an IgC domain, or a specific binding fragment of the IgV domain or a specific binding fragment of the IgC domain in which at least one of the IgV or IgC domain contains the one or more amino acid modifications (e.g., substitutions). In some embodiments, the variant CD80 polypeptides can comprise an IgV domain and an IgC domain, or a specific binding fragment of the IgV domain and a specific binding fragment of the IgC domain. In some embodiments, the variant CD80 polypeptide comprises a full-length IgV domain. In some embodiments, the variant CD80 polypeptide comprises a full-length IgC domain. In some embodiments, the variant CD80 polypeptide comprises a specific binding fragment of the IgV domain. In some embodiments, the variant CD80 polypeptide comprises a specific binding fragment of the IgC domain. In some embodiments, the variant CD80 polypeptide comprises a full-length IgV domain and a full-length IgC domain. In some embodiments, the variant CD80 polypeptide comprises a full-length IgV domain and a specific binding fragment of an IgC domain. In some embodiments, the variant CD80 polypeptide comprises a specific binding fragment of an IgV domain and a full-length IgC domain. In some embodiments, the variant CD80 polypeptide comprises a specific binding fragment of an IgV domain and a specific binding fragment of an IgC domain.

In any of such embodiments, the one or more amino acid modifications (e.g., substitutions) of the variant CD80 polypeptides can be located in any one or more of the CD80 polypeptide domains. For example, in some embodiments, one or more amino acid modifications (e.g., substitutions) are located in the extracellular domain of the variant CD80 polypeptide. In some embodiments, one or more amino acid modifications (e.g., substitutions) are located in the IgV domain or specific binding fragment of the IgV domain. In some embodiments, one or more amino acid modifications (e.g., substitutions) are located in the IgC domain or specific binding fragment of the IgC domain.

Generally, each of the various attributes of polypeptides are separately disclosed below (e.g., soluble and membrane bound polypeptides, affinity of CD80 for CD28, PD-L1, and CTLA-4, number of variations per polypeptide chain, number of linked polypeptide chains, the number and nature of amino acid alterations per variant CD80, etc.). However, as will be clear to the skilled artisan, any particular polypeptide can comprise a combination of these independent attributes. It is understood that reference to amino acids, including to a specific sequence set forth as a SEQ ID NO used to describe domain organization of an IgSF domain are for illustrative purposes and are not meant to limit the scope of the embodiments provided. It is understood that polypeptides and the description of domains thereof are theoretically derived based on homology analysis and alignments with similar molecules. Thus, the exact locus can vary, and is not necessarily the same for each protein. Hence, the specific IgSF domain, such as specific IgV domain or IgC domain, can be several amino acids (such as one, two, three or four) longer or shorter.

Further, various embodiments of the invention as discussed below are frequently provided within the meaning of a defined term as disclosed above. The embodiments described in a particular definition are therefore to be interpreted as being incorporated by reference when the defined term is utilized in discussing the various aspects and attributes described herein. Thus, the headings, the order of presentation of the various aspects and embodiments, and the separate disclosure of each independent attribute is not meant to be a limitation to the scope of the present disclosure.

Exemplary Modifications

Provided herein are variant CD80 polypeptides containing at least one affinity-modified IgSF domain (e.g. IgV or IgC) or a specific binding fragment thereof relative to an IgSF domain contained in a wild-type or unmodified CD80 polypeptide such that the variant CD80 polypeptide exhibits altered (increased or decreased) binding activity or affinity for one or more ligands CD28, PD-L1 or CTLA-4 compared to a wild-type or unmodified CD80 polypeptide. In some embodiments, a variant CD80 polypeptide has a binding affinity for CD28, PD-L1, and/or CTLA-4 that differs from that of a wild-type or unmodified CD80 polypeptide control sequence as determined by, for example, solid-phase ELISA immunoassays, flow cytometry or Biacore assays. In some embodiments, the variant CD80 polypeptide has an increased binding affinity for CD28, PD-L1, and/or CTLA-4. In some embodiments, the variant CD80 polypeptide has a decreased binding affinity for CD28, PD-L1, and/or CTLA-4, relative to a wild-type or unmodified CD80 polypeptide. The CD28, PD-L1 and/or the CTLA-4 can be a mammalian protein, such as a human protein or a murine protein.

Binding affinities for each of the cognate binding partners are independent; that is, in some embodiments, a variant CD80 polypeptide has an increased binding affinity for one, two or three of CD28, PD-L1, and CTLA-4, and/or a decreased binding affinity for one, two or three of CD28, PD-L1, and CTLA-4, relative to a wild-type or unmodified CD80 polypeptide.

In some embodiments, the variant CD80 polypeptide has an increased binding affinity for CD28, relative to a wild-type or unmodified CD80 polypeptide. In some embodiments, the variant CD80 polypeptide has an increased binding affinity for PD-L1, relative to a wild-type or unmodified CD80 polypeptide. In some embodiments, the variant CD80 polypeptide has an increased binding affinity for CTLA-4, relative to a wild-type or unmodified CD80 polypeptide. In some embodiments, the variant CD80 polypeptide has a decreased binding affinity for CD28, relative to a wild-type or unmodified CD80 polypeptide. In some embodiments, the variant CD80 polypeptide has a decreased binding affinity for PD-L1, relative to a wild-type or unmodified CD80 polypeptide. In some embodiments, the variant CD80 polypeptide has a decreased binding affinity for CTLA-4, relative to a wild-type or unmodified CD80 polypeptide.

In some embodiments, the variant CD80 polypeptide has an increased binding affinity for CD28 and PD-L1, relative to a wild-type or unmodified CD80 polypeptide. In some embodiments, the variant CD80 polypeptide has an increased binding affinity for CD28 and a decreased binding affinity for PD-L1, relative to a wild-type or unmodified CD80 polypeptide. In some embodiments, the variant CD80 polypeptide has a decreased binding affinity for CD28 and PD-L1, relative to a wild-type or unmodified CD80 polypeptide. In some embodiments, the variant CD80 polypeptide has a decreased binding affinity for CD28 and an increased binding affinity for PD-L1, relative to a wild-type or unmodified CD80 polypeptide.

In some embodiments, the variant CD80 polypeptide has an increased binding affinity for CD28 and CTLA-4, relative to a wild-type or unmodified CD80 polypeptide. In some embodiments, the variant CD80 polypeptide has an increased binding affinity for CD28 and a decreased binding affinity for CTLA-4, relative to a wild-type or unmodified CD80 polypeptide. In some embodiments, the variant CD80 polypeptide has a decreased binding affinity for CD28 and CTLA-4, relative to a wild-type or unmodified CD80 polypeptide. In some embodiments, the variant CD80 polypeptide has a decreased binding affinity for CD28 and an increased binding affinity for CTLA-4, relative to a wild-type or unmodified CD80 polypeptide.

In some embodiments, the variant CD80 polypeptide has an increased binding affinity for PD-L1 and CTLA-4, relative to a wild-type or unmodified CD80 polypeptide. In some embodiments, the variant CD80 polypeptide has an increased binding affinity for PD-L1 and a decreased binding affinity for CTLA-4, relative to a wild-type or unmodified CD80 polypeptide. In some embodiments, the variant CD80 polypeptide has a decreased binding affinity for PD-L1 and CTLA-4, relative to a wild-type or unmodified CD80 polypeptide. In some embodiments, the variant CD80 polypeptide has a decreased binding affinity for PD-L1 and an increased binding affinity for CTLA-4, relative to a wild-type or unmodified CD80 polypeptide.

In some embodiments, the variant CD80 polypeptide has an increased binding affinity for CD28, PD-L1, and CTLA-4, relative to a wild-type or unmodified CD80 polypeptide. In some embodiments, the variant CD80 polypeptide has an increased binding affinity for CD28 and PD-L1, and a decreased binding affinity for CTLA-4, relative to a wild-type or unmodified CD80 polypeptide. In some embodiments, the variant CD80 polypeptide has an increased binding affinity for CD28 and CTLA-4, and a decreased binding affinity for PD-L1, relative to a wild-type or unmodified CD80 polypeptide. In some embodiments, the variant CD80 polypeptide has a decreased binding affinity for CD28 and PD-L1, and an increased binding affinity for CTLA-4, relative to a wild-type or unmodified CD80 polypeptide. In some embodiments, the variant CD80 polypeptide has a decreased binding affinity for CD28 and an increased binding affinity for PD-L1 and CTLA-4, relative to a wild-type or unmodified CD80 polypeptide. In some embodiments, the variant CD80 polypeptide has an increased binding affinity for CD28, and a decreased binding affinity for PD-L1 and CTLA-4, relative to a wild-type or unmodified CD80 polypeptide. In some embodiments, the variant CD80 polypeptide has a decreased binding affinity for CD28, CTLA-4, and PD-L1, relative to a wild-type or unmodified CD80 polypeptide. In some embodiments, the variant CD80 polypeptide has a decreased binding affinity for CD28, and an increased binding affinity for PD-L1 and CTLA-4, relative to a wild-type or unmodified CD80 polypeptide.

In some embodiments, a variant CD80 polypeptide with increased or greater binding affinity to CD28, PD-L1, and/or CTLA-4 will have an increase in binding affinity relative to the wild-type or unmodified CD80 polypeptide control of at least about 5%, such as at least about 10%, 15%, 20%, 25%, 35%, or 50% for the CD28, PD-L1, and/or CTLA-4. In some embodiments, the increase in binding affinity relative to the wild-type or unmodified CD80 polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the wild-type or unmodified CD80 polypeptide has the same sequence as the variant CD80 polypeptide except that it does not contain the one or more amino acid modifications (e.g., substitutions).

In some embodiments, a variant CD80 polypeptide with decreased or reduced binding affinity to CD28, PD-L1, and/or CTLA-4 will have decrease in binding affinity relative to the wild-type or unmodified CD80 polypeptide control of at least 5%, such as at least about 10%, 15%, 20%, 30%, 40%, 50%, 60%, 70%, 80%, 90% or more for the CD28, PD-L1, and/or CTLA-4. In some embodiments, the decrease in binding affinity relative to the wild-type or unmodified CD80 polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the wild-type or unmodified CD80 polypeptide has the same sequence as the variant CD80 polypeptide except that it does not contain the one or more amino acid modifications (e.g., substitutions).

In some embodiments, the equilibrium dissociation constant ($K_d$) of any of the foregoing embodiments to CD28, PD-L1, and/or CTLA-4 can be less than $1\times10^{-5}$ M, $1\times10^{-6}$ M, $1\times10^{-7}$ M, $1\times10^{-8}$ M, $1\times10^{-9}$ M, $1\times10^{-10}$ M or $1\times10^{-11}$ M, or $1\times10^{-12}$ M.

The wild-type or unmodified CD80 sequence does not necessarily have to be used as a starting composition to generate variant CD80 polypeptides described herein. Therefore, use of the term "substitution" does not imply that the provided embodiments are limited to a particular method of making variant CD80 polypeptides. Variants CD80 polypeptides can be made, for example, by de novo peptide synthesis and thus does not necessarily require a "substitution" in the sense of altering a codon to encode for the substitution. This principle also extends to the terms "addition" and "deletion" of an amino acid residue which likewise do not imply a particular method of making. The means by which the variant CD80 polypeptides are designed or created is not limited to any particular method. In some embodiments, however, a wild-type or unmodified CD80 encoding nucleic acid is mutagenized from wild-type or unmodified CD80 genetic material and screened for desired specific binding affinity and/or induction of IFN-gamma expression or other functional activity according to the methods disclosed in the Examples or other methods known to a skilled artisan. In some embodiments, a variant CD80 polypeptide is synthesized de novo utilizing protein or nucleic acid sequences available at any number of publicly available databases and then subsequently screened. The National Center for Biotechnology Information provides such information and its website is publicly accessible via the internet as is the UniProtKB database as discussed previously.

Unless stated otherwise, as indicated throughout the present disclosure, the amino acid substitution(s) are designated by amino acid position number corresponding to the numbering of positions of the unmodified ECD sequence set forth in SEQ ID NO:28 or also, where applicable, the unmodified IgV sequence set forth in SEQ ID NO: 152 or 372 (containing residues 1-101 or 1-107, respectively, of SEQ ID NO:28 depending on annotation convention) as follows:

```
                                          (SEQ ID NO: 28)
VIHVTKEVKEVATLSCGHNVSVEELAQTRIYWQKEKKMVLTMMSGDMNIW

PEYKNRTIFDITNNLSIVILALRPSDEGTYECVVLKYEKDAFKREHLAEV

TLSVKADFPTPSISDFEIPTSNIRRIICSTSGGFPEPHLSWLENGEELNA

INTTVSQDPETELYAVSSKLDFNMTTNHSFMCLIKYGHLRVNQTFNWNTT

KQEHFPDN

                                         (SEQ ID NO: 152)
VIHVTKEVKEVATLSCGHNVSVEELAQTRIYWQKEKKMVLTMMSGDMNIW

PEYKNRTIFDITNNLSIVILALRPSDEGTYECVVLKYEKDAFKREHLAEV

T

                                         (SEQ ID NO: 372)
VIHVTKEVKEVATLSCGHNVSVEELAQTRIYWQKEKKMVLTMMSGDMNIW

PEYKNRTIFDITNNLSIVIQALRPSDEGTYECVVLKYEKDGFKREHLAEV

TLSVKAD
```

It is within the level of a skilled artisan to identify the corresponding position of a modification, e.g. amino acid substitution, in a CD80 polypeptide, including portion thereof containing an IgSF domain (e.g. IgV) thereof, such as by alignment of a reference sequence with SEQ ID NO:28 or SEQ ID NO:152 or SEQ ID NO:372. In the listing of modifications throughout this disclosure, the amino acid position is indicated in the middle, with the corresponding unmodified (e.g. wild-type) amino acid listed before the number and the identified variant amino acid substitution listed after the number. If the modification is a deletion of the position a "del" is indicated and if the modification is an insertion at the position an "ins" is indicated.

In some embodiments, the variant CD80 polypeptide has one or more amino acid modifications (e.g., substitutions) in a wild-type or unmodified CD80 sequence. The one or more amino acid modifications (e.g., substitutions) can be in the ectodomain (extracellular domain) of the wild-type or unmodified CD80 sequence, such as the extracellular domain. In some embodiments, the one or more amino acid modifications (e.g., substitutions) are in the IgV domain or specific binding fragment thereof. In some embodiments, the one or more amino acid modifications (e.g., substitutions) are in the IgC domain or specific binding fragment thereof. In some embodiments of the variant CD80 polypeptide, some of the one or more amino acid modifications (e.g., substitutions) are in the IgV domain or a specific binding fragment thereof, and some of the one or more amino acid modifications (e.g., substitutions) are in the IgC domain or a specific binding fragment thereof.

In some embodiments, the variant CD80 polypeptide has up to 1, 2, 3, 4, 5, 6, 7, 8, 9, 10, 11, 12, 13, 14, 15, 16, 17, 18, 19, or 20 amino acid modifications (e.g., substitutions). The modifications (e.g., substitutions) can be in the IgV domain or the IgC domain. In some embodiments, the variant CD80 polypeptide has up to 1, 2, 3, 4, 5, 6, 7, 8, 9, 10, 11, 12, 13, 14, 15, 16, 17, 18, 19, or 20 amino acid modifications (e.g., substitutions) in the IgV domain or specific binding fragment thereof. In some embodiments, the variant CD80 polypeptide has up to 1, 2, 3, 4, 5, 6, 7, 8, 9, 10, 11, 12, 13, 14, 15, 16, 17, 18, 19, or 20 amino acid modifications (e.g., substitutions) in the IgC domain or specific binding fragment thereof. In some embodiments, the variant CD80 polypeptide has at least about 85%, 86%, 86%, 88%, 89%, 90%, 91%, 92%, 93%, 94%, 95%, 96%, 97%, 98%, or 99% sequence identity with the wild-type or unmodified CD80 polypeptide or specific binding fragment thereof, such as the amino acid sequence of SEQ ID NO: 28, 152, or 372.

In some embodiments, the variant CD80 polypeptide has one or more amino acid modifications (e.g., substitutions) in an unmodified CD80 or specific binding fragment there of corresponding to position(s) 4, 9, 10, 11, 12, 13, 14, 15, 16, 17, 18, 20, 21, 22, 24, 25, 27, 28, 29, 30, 31, 33, 36, 37, 38, 40, 41, 42, 43, 44, 47, 48, 50, 52, 53, 54, 59, 60, 61, 62, 63, 64, 65, 66, 67, 68, 69, 70, 72, 74, 76, 77, 80, 81, 83, 85, 86, 87, 88, 89, 90, 91, 92, 93, 94, 95, 96, 97, 99, 102, 103, 104, 107, 108, 109, 110, 114, 115, 116, 117, 118, 120, 121, 122, 126, 127, 128, 129, 130, 133, 137, 140, 142, 143, 144, 148, 149, 152, 154, 160, 162, 164, 168, 169, 174, 175, 177, 178, 183, 178, 185, 188, 190, 192, 193, or 199 with reference to numbering of SEQ ID NO: 28. In some embodiments, such variant CD80 polypeptides exhibit altered binding affinity to one or more of CD28, PD-L1, or CTLA-4 compared to the wild-type or unmodified CD80 polypeptide. For example, in some embodiments, the variant CD80 polypeptide exhibits increased binding affinity to CD28, PD-L1, and/or CTLA-4 compared to a wild-type or unmodified CD80 polypeptide. In some embodiments, the variant CD80 polypeptide exhibits decreased binding affinity to CD28, PD-L1, and/or CTLA-4 compared to a wild-type or unmodified CD80 polypeptide.

In some embodiments, the variant CD80 polypeptide has one or more amino acid substitution selected from V4M, K9E, E10R, V11S, A12G, A12T, A12V, T13N, L14A, S15V, S15F, C16S, C16G, C16L, G17W, H18L, H18R, H18Y, V20L, S21P, V22A, E24G, L25P, Q27R, T28A, T28S, R29C, R29D, R29H, R29V, I30V, Y31F, Y31H, Y31L, Q33H, K36E, K36G, K37E, K37Q, M38I, M38L, M38T, M38V, L40M, T41A, T41G, T41D, T41I, M42T, M43I, M43Q, M43R, M43V, S44P, M47T, N48D, N48I, W50G, E52G, Y53C, K54M, F59L, F59S, D60V, I61N, T62S, N63S, N64S, L65H, S66H, I67F, I67T, V68A, V68M, I69T, L70Q, L70P, L70R, L72P, P74L, D76G, E77G, E77K, Y80N, E81A, E81R, E81V, V83A, V83I, L85I, L85R, K86E, Y87N, E88D, E88G, K89E, K89N, K89R, D90K, D90L, D90N, A91E, A91G, A91S, A91T, F92L, F92N, F92P, F92Y, K93I, K93E, K93Q, K93R, K93V, R94G, R94L, R94F, E95K, H96R, L97R, E99D, E99G, L102S, S103L, S103P, V104A, V104L, D107N, F108L, P109S, P109H, T110A, S114T, D115G, F116S, F116L, E117V, E117G, I118V, I118A, I118T, T120S, S121P, N122S, I126L, I126V, I127T, C128Y, C128R, S129L, S129P, T130A, G133D, P137L, S140T, L142S, E143G, N144D, N144S, L148S, N149D, N149S, N152T, T154I, T154A, E160G, E162G, Y164H, S168G, K169E, K169I, K169S, M174T, M174V, T175A, N177S, H178R, L183H, K185E, H188D, H188Q, R190S, N192D, Q193L, or T199S. In some embodiments, the variant CD80 polypeptide has one or more amino acid substitutions selected from the group consisting of V4M, K9E, EO1R, V11S, A12G, A12T, A12V, T13N, L14A, S15V, S15F, C16S, C16G, C16L, G17W, H18L, H18R, H18Y, V20L, S21P, V22A, E24G, L25P, Q27R, T28A, T28S, R29C, R29D, R29H, R29V, I30V, Y31F, Y31H, Y31L, Q33H, K36E, K36G, K37E, K37Q, M38I, M38L, M38T, M38V, L40M, T41A, T41G, T41D, T41I, M42T, M43I, M43Q, M43R, M43V, S44P, M47T, N48D, N48I, W50G, E52G, Y53C, K54M, F59L, F59S, D60V, I61N, T62S, N63S, N64S, L65H, S66H, I67F, I67T, V68A, V68M, I69T, L70Q, L70P, L70R, L72P, P74L, D76G, E77G, E77K, Y80N, E81A, E81R, E81V, V83A, V83I, L85I, L85R, K86E, Y87N, E88D, E88G, K89E, K89N, K89R, D90K, D90L, D90N, A91E, A91G, A91S, A91T, F92L, F92N, F92P, F92Y, K93I, K93E, K93Q, K93R, K93V, R94G, R94L, R94F, E95K, H96R, L97R, E99D, E99G, L102S, S103L, S103P, V104A, V104L, D107N, F108L, P109S, P109H, T110A, S114T, D115G, F116S, F116L, E117V, E117G, I118V, I118A, I118T, T120S, S121P, N122S, I126L, I126V, I127T, C128Y, C128R, S129L, S129P, T130A, G133D, P137L, S140T, L142S, E143G, N144D, N144S, L148S, N149D, N149S, N152T, T154I, T154A, E160G, E162G, Y164H, S168G, K169E, K169I, K169S, M174T, M174V, T175A, N177S, H178R, L183H, K185E, H188D, H188Q, R190S, N192D, Q193L, T199S or a conservative amino acid substitution thereof.

In some embodiments, the one or more amino acid modification, e.g. substitution is L70Q/A91G, L70Q/A91G/T130A, L70Q/A91G/I118A/T120S/T130A, V4M/L70Q/A91G/T120S/T130A, L70Q/A91G/T120S/T130A, V20L/L70Q/A91S/T120S/T130A, S44P/L70Q/A91G/T130A, L70Q/A91G/E117G/T120S/T130A, A91G/T120S/T130A, L70R/A91G/T120S/T130A, L70Q/E81A/A91G/T120S/I127T/T130A, L70Q/Y87N/A91G/T130A, T28S/L70Q/A91G/E95K/T120S/T130A, N63S/L70Q/A91G/T120S/T130A, K36E/I67T/L70Q/A91G/T120S/T130A/N152T, E52G/L70Q/A91G/T120S/T130A, K37E/F59S/L70Q/A91G/T120S/T130A, A91G/S103P, K89E/T130A, D60V/A91G/T120S/T130A, K54M/A91G/T120S, M38T/L70Q/E77G/A91G/T120S/T130A/N152T, R29H/E52G/L70R/E88G/A91G/T130A, Y31H/T41G/L70Q/A91G/T120S/T130A, V68A/T110A, S66H/D90G/T110A/F116L, R29H/E52G/T120S/T130A, A91G/L102S, I67T/L70Q/A91G/T120S, L70Q/A91G/T110A/T120S/T130A, M38V/T41D/M43I/W50G/D76G/V83A/K89E/T120S/T130A, V22A/L70Q/S121P, A12V/S15F/Y31H/T41G/T130A/P137L/N152T, I67F/L70R/E88G/A91G/T120S/T130A, E24G/L25P/L70Q/T120S, A91G/F92L/F108L/T120S, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144S/N149S, R29D/Y31L/Q33H/K36G/M38I/T41A/M42T/M43R/M47T/E81V/L85R/K89N/A91T/F92P/K93V/R94L/L148S/N149S, E24G/R29D/Y31L/Q33H/K36G/M38I/T41A/M43R/M47T/F59L/E81V/L85R/K89N/A91T/F92P/K93V/R94L/H96R/N149S/C182S, R29D/Y31L/Q33H/K36G/M38I/T41A/M43R/M47T/E81V/L85R/K89N/A91T/F92P/K93V/R94L/N149S, R29V/M43Q/E81R/L85I/K89R/D90L/A91E/F92N/K93Q/R94G, T41I/A91G, K89R/D90K/

A91G/F92Y/K93R/N122S/N177S, K89R/D90K/A91G/F92Y/K93R, K36G/K37Q/M38I/F59L/E81V/L85R/K89N/A91T/F92P/K93V/R94L/E99G/T130A/N149S, E88D/K89R/D90K/A91G/F92Y/K93R, K36G/K37Q/M38I/L40M, R29H/Y31H/T41G/Y87N/E88G/K89E/D90N/A91G/P109S, A12T/H18L/M43V/F59L/E77K/P109S/I118T, R29V/Y31F/K36G/M38L/M43Q/E81R/V83I/L85I/K89R/D90L/A91E/F92N/K93Q/R94G, V68M/L70P/L72P/K86E, R29D/Y31L/Q33H/K36G/M38I/T41A/M43R/M47T/E81V/L85R/K89N/A91T/F92P/K93V/R94L/T120S/I127T/T130A/K169E, R29D/Y31L/Q33H/K36G/M38I/T41A/M43R/M47T/L70Q/E81V/L85R/K89N/A91T/F92P/K93V/R94L/T120S/I127T/T130A, H18L/R29D/Y31L/Q33H/K36G/M38I/T41A/M43R/M47T/E81V/L85R/K89N/A91T/F92P/K93V/R94L/T120S/I127T/T130A/K169E, R29D/Y31L/Q33H/K36G/M38I/T41A/M43R/M47T/E81V/L85R/K89N/A91T/F92P/K93V/R94L/T120S/T130A/M174T, R29D/Y31L/Q33H/K36G/M38I/T41A/M43R/M47T/F59L/E81V/L85R/K89N/A91T/F92P/K93V/R94L/T120S/I127T/T130A/H188D, H18R/R29D/Y31L/Q33H/K36G/K37E/M38I/T41A/M43R/M47T/L70Q/E81V/L85R/K89N/A91T/F92P/K93V/R94L/T120S/T130A/K169E/H188D, R29D/Y31L/Q33H/K36G/M38I/T41A/M43R/M47T/L70Q/E81V/L85R/K89N/A91T/F92P/K93V/R94L/T120S/I127T/T130A/E143G/K169E/M174V/H188D, R29D/Y31L/Q33H/K36G/M38I/T41A/M43R/M47T/L70Q/E81V/L85R/K89N/A91T/F92P/K93V/R94L/T120S/I127T/T130A, R29D/Y31L/Q33H/K36G/M38I/T41A/M43R/M47T/E81V/L85R/K89N/A91T/F92P/K93V/R94L/T120S/I127T/T130A/H188D, R29D/Y31L/Q33H/K36G/M38I/T41A/M43R/M47T/L70Q/E81V/L85R/K89N/A91T/F92P/K93V/R94L/T120S/I127T/T130A/K169E, R29D/Y31L/Q33H/K36G/M38I/T41A/M43R/M47T/L70Q/E81V/L85R/K89N/A91T/F92P/K93V/R94L/T120S/I127T/T130A, R29D/Y31L/Q33H/K36G/M38I/T41A/M43R/M47T/L85R/K89N/A91T/F92P/K93V/R94L/T120S/I127T/T130A/K169E/H188D, R29D/Y31L/Q33H/K36G/M38I/T41A/M43R/M47T/E81V/L85R/K89N/A91T/F92P/K93V/R94L/F108L/T120S/T130A/K169E/H188D, R29D/Y31L/Q33H/K36G/M38I/T41A/M43R/M47T/L70Q/E81V/L85R/K89N/A91T/F92P/K93V/R94L/T130A/H188D, R29D/Y31L/Q33H/K36G/M38I/T41A/M43R/M47T/L70Q/E81V/L85R/K89N/A91T/F92P/K93V/R94L/T120S/I127T/T130A/K169E, H18L/R29D/Y31L/Q33H/K36G/M38I/T41A/M43R/M47T/L70Q/E81V/L85R/K89N/A91T/F92P/K93V/R94L/T120S/T130A/K169E/H188D, R29D/Y31L/Q33H/K36G/M38I/T41A/M43R/M47T/E81V/L85R/K89N/A91T/F92P/K93V/R94L/T120S/I127T/C128Y/T130A/H188D, R29D/Y31L/Q33H/K36G/M38I/T41A/M43R/M47T/E81V/L85R/K89N/A91T/F92P/K93V/R94F/T130A/K169E, H18L/R29D/Y31L/Q33H/K36G/M38I/T41A/M43R/M47T/E81V/L85R/K89N/A91T/F92P/K93V/R94L/T130A, H18L/R29D/Y31L/Q33H/K36G/M38I/T41A/M43R/M47T/L70Q/E81V/L85R/K89N/A91T/F92P/K93V/R94L/T120S/T130A/K169E, R29D/Y31L/Q33H/K36G/M38I/T41A/M43R/M47T/L70Q/E81V/L85R/K89N/A91T/F92P/K93I/R94L/L97R/T130A, R29D/Y31L/Q33H/K36G/M38I/T41A/M43R/M47T/L70Q/E81V/L85R/K89N/A91T/F92P/K93I/R94L/L97R/T130A/L148S, H18L/R29D/Y31L/Q33H/K36G/M38I/T41A/M43R/M47T/E81V/L85R/K89N/A91T/F92P/K93V/R94L/I118V/T120S/I127T/T130A/K169E, R29D/Y31L/Q33H/K36G/M38I/T41A/M43R/M47T/I61N/E81V/L85R/K89N/A91T/F92P/K93V/R94F/V104A/T120S/T130A, R29D/Y31L/Q33H/K36G/M38I/T41A/M43R/M47T/E81V/L85R/K89N/F92P/K93V/R94F/I118V/T130A, R29D/Y31L/Q33H/K36G/M38I/T41A/M43R/M47T/T62S/E81V/L85R/K89N/A91T/F92P/K93V/R94L/I118V/T120S/T130A/K169E/T175A, H18L/R29D/Y31L/Q33H/K36G/M38I/T41A/M43R/M47T/E81V/L85R/K89N/A91T/F92P/K93V/R94L/F116S/T130A/H188D, H18L/R29D/Y31L/Q33H/K36G/M38I/T41A/M43R/M47T/E81V/L85R/K89N/A91T/F92P/K93V/R94L/T120S/I127T/T130A/L142S/H188D, C16S/H18L/R29D/Y31L/Q33H/K36G/M38I/T41A/M43R/M47T/E81V/L85R/K89N/A91T/F92P/K93V/R94L/T110A/H188D, R29D/Y31L/Q33H/K36G/M38I/T41A/M43R/M47T/A91G/T120S/I127T/T130A/H188D, R29D/Y31L/Q33H/K36G/M38I/T41A/M43R/M47T/L70Q/D76G/A91G/S103L/T120S/I127T/T 130A, DELTAQ33/Y53C/L85R/K89N/A91T/F92P/K93V/R94L/T120S/I127T/T130A/K169E, T62S/E81V/L85R/K89N/A91T/F92P/K93V/R94L/T120S/T130A/K169E, R29D/Y31L/Q33H/K36G/M38I/T41A/M43R/M47T/E81V/L85R/K89N/A91T/F92P/K93V/R94L/S129L/H188D, K9E/E10R/V11S/A12G/T13N/K14A/S15V/C16L/G17W/H18Y/Y53C/L70Q/D90G/T130A/N149D/N152T/H188D, H18L/R29D/Y31L/Q33H/K36G/T41A/M43R/M47T/E81V/L85R/K89N/A91T/F92P/K93V/R94L/I118V/T120S/I127T/T130A/H188D, K89E/K93E/T130A, S21P/R29D/Y31L/Q33H/K36G/M38I/T41A/M43R/M47T/N48I/V68A/E81V/L85R/K89N/A91T/F92P/K93V/R94L/P109H/I126L/K169I, H18L/R29D/Y31L/Q33H/K36G/M38I/T41A/M43R/M47T/P74L/Y80N/E81V/L85R/K89N/A91T/F92P/K93V/R94L/L97R, S21P/R29D/Y31L/Q33H/K36G/M38I/T41A/M43R/M47T/P74L/Y80N/E81V/L85R/K89N/D90N/A91T/F92P/K93V/R94L/T130A/N149S/E162G, H18L/R29D/Y31L/Q33H/K36G/M38I/T41A/M43R/M47T/V68M/E81V/L85R/K89N/A91T/F92P/K93V/R94L/T130A, R29D/Y31L/Q33H/K36G/M38I/T41A/M43R/M47T/V68M/E81V/L85R/K89N/A91T/F92P/K93V/R94L/T130A/N149S/R190S, H18L/R29D/Y31L/Q33H/K36G/M38I/T41A/M43R/M47T/P74L/Y80N/E81V/L85R/K89N/A91T/F92P/K93V/R94L/T130A/R190S, C16G/V22A/R29D/Y31L/Q33H/K36G/M38I/T41A/M43R/M47T/V68M/D76G/E81V/L85R/K89N/A91T/F92P/K93V/R94L/I118T/T130A/S140T/N149S/K169I/H178R/N192D, R29D/Y31L/Q33H/K36G/M38I/T41A/M43R/M47T/E81V/L85R/K89N/A91T/F92P/K93V/R94F/E117V/I118T/N149S/S168G/H188Q, V22A/R29D/Y31L/Q33H/K36G/M38I/T41A/M43R/M47T/V68M/E81V/L85R/K89N/A91T/F92P/K93V/R94L/T130A, R29D/Y31L/Q33H/K36G/M38I/T41A/M43R/M47T/N64S/E81V/L85R/K89N/A91T/F92P/K93V/R94F/I118T/T130A/N149S/K169I, V22A/R29D/Y31L/Q33H/K36G/M38I/T41A/M43R/M47T/V68M/E81V/L85R/K89N/A91T/F92P/K93V/R94L/D115G/I118T/T130A/G133D/N149S, S129P, A91G/S129P, I69T/L70Q/A91G/T120S, Y31H/S129P, T28A/R29D/Y31L/Q33H/K36G/M38I/T41A/M43R/M47T/E81V/L85R/K89N/A91T/F92P/K93V/R94L/V104L/T130A/N149S, H18L/R29D/Y31L/Q33H/K36G/M38I/T41A/M43R/M47T/E81V/L85R/K89N/A91T/F92P/K93V/R94L/L97R/N149S/H188Q, H18L/R29D/Y31L/Q33H/K36G/M38I/T41A/M43R/M47T/E81V/L85R/K89N/A91T/F92P/K93V/R94L/L97R/N149S, H18L/R29D/Y31L/Q33H/K36G/M38I/T41A/M43R/M47T/V68A/E81V/L85R/K89N/A91T/F92P/K93V/R94L/T130A/N149S/T154I, A12G/R29D/Y31L/Q33H/K36G/M38I/T41A/M43R/M47T/V68A/E81V/L85R/K89N/A91T/F92P/K93V/R94L/L97R/T130A/L183H, R29D/Y31L/Q33H/K36G/M38I/T41A/M43R/M47T/E81V/L85R/K89N/A91T/F92P/K93V/R94L/I118T/T130A/S140T/N149S/K169S, R29D/Y31L/Q33H/K36G/M38I/T41A/M43R/M47T/E81V/L85R/K89N/A91T/F92P/K93V/R94L/I118T/T130A/N149S/K169I/Q193L, V22A/R29D/Y31L/Q33H/K36G/M38I/T41A/M43R/M47T/

E81V/L85R/K89N/A91T/F92P/K93 V/R94L/I118T/T130A/N149S, R29D/Y31L/Q33H/K36 G/M38I/T41A/M43R/M47T/E81V/L85R/K89N/A91T/F92P/K93V/R94L/I118T/T130A/N149S, R29D/Y31L/Q33H/K36 G/M38I/T41A/M43R/M47T/E81V/L85R/K89N/A91T/F92P/K93V/R94L/I118T/T130A/N149S/K169I, R29D/Y31L/Q33H/K36 G/M38I/T41A/M43R/M47T/E81V/L85R/K89N/A91T/F92P/K93V/R94F/T130A/N149S/K169I, I118T/C128R, Q27R/R29C/M42T/S129P/E160G, S129P/T154A, S21P/L70Q/D90G/T120S/T130A, L70Q/A91G/N144D, L70Q/A91G/I118A/T120S/T130A/K169E, V4M/L70Q/A91G/I118V/T120S/T130A/K169E, L70Q/A91G/I118V/T120S/T130A/K169E, L70Q/A91G/I118V/T120S/T130A, V20L/L70Q/A91S/I118V/T120S/T130A, L70Q/A91G/E117G/I118V/T120S/T130A, A91G/I118V/T120S/T130A, L70R/A91G/I118V/T120S/T130A/T199S, L70Q/E81A/A91G/I118V/T120S/I127T/T130A, T28S/L70Q/A91G/E95K/I118V/T120S/I126V/T130A/K169E, N63S/L70Q/A91G/S114T/I118V/T120S/T130A, K36E/I67T/L70Q/A91G/I118V/T120S/T130A/N152T, E52G/L70Q/A91G/D107N/I118V/T120S/T130A/K169E, K37E/F59S/L70Q/A91G/I118V/T120S/T130A/K185E, D60V/A91G/I118V/T120S/T130AK169E, K54M/L70Q/A91G/Y164H/T120S, M38T/L70Q/E77G/A91G/I118V/T120S/T130A/N152T, Y31H/T41G/M43L/L70Q/A91G/I118V/T120S/I126V/T130A, L65H/D90G/T110A/F116L, R29H/E52G/D90N/I118V/T120S/T130A, I67T/L70Q/A91G/I118V/T120S, L70Q/A91G/T110A/I118V/T120S/T130A, M38V/T41D/M43I/W50G/D76G/V83A/K89E/I118V/T120S/I126V/T130A, A12V/S15F/Y31H/M38L/T41 G/M43L/D90N/T130A/P137L/N149D/N152T, I67F/L70R/E88G/A91G/I118V/T120S/T130A, E24G/L25P/L70Q/A91G/I118V/T120S/N152T, A91G/F92L/F108L/I118V/T120S, E88D/K89R/D90K/A91G/F92Y/K93R/N122S/N177S, K36G/K37Q/M38I/L40M/F59L/E81V/L85R/K89N/A91T/F92P/K93V/R94L/E99G/T130A/N149S, K36G/L40M, R29D/Y31L/Q33H/K36G/M38I/T41A/M43R/M47T/E81V/L85R/K89N/A91T/F92P/K93V/R94L/I118V/T120S/I127T/T130A/K169E, R29D/Y31L/Q33H/K36G/M38I/T41A/M43R/M47T/L70Q/E81V/L85R/K89N/A91T/F92P/K93 V/R94L/I118V/T120S/I127T/T130A, H18L/R29D/Y31L/Q33H/K36G/M38I/T41A/M43R/M47T/E81V/L85R/K89N/A91T/F92P/K93V/R94L/I118V/T120S/I127T/T130A/K169E, R29D/Y31L/Q33H/K36G/M38I/T41A/M43R/M47T/E81V/L85R/K89N/A91T/F92P/K93V/R94L/I118V/T120S/T130A/K169E/M174T, R29D/Y31L/Q33H/K36G/M38I/T41A/M43R/M47T/N48D/F59L/E81V/L85R/K89N/A91T/F92P/K93V/R94L/I118V/T120S/I127T/T130A/H188D, H18R/R29D/Y31L/Q33H/K36G/K37E/M38I/T41A/M43R/M47T/L70Q/E81V/L85R/K89N/A91T/F92P/K93V/R94L/I118V/T120S/T130A/K169E/H188D, R29D/Y31L/Q33H/K36G/M38I/T41A/M43R/M47T/L70Q/E81V/L85R/K89N/A91T/F92P/K93V/R94L/I118V/T120S/I127T/T130A/E143G/K169E/M174V/H188D, R29D/I30V/Y31L/Q33H/K36G/M38I/T41A/M43R/M47T/E81V/L85R/K89N/A91T/F92P/K93V/R94L/I118V/T120S/I127T/T130A/H188D, R29D/Y31L/Q33H/K36G/M38I/T41A/M43R/M47T/E81V/L85R/K89N/A91T/F92P/K93V/R94L/I118V/T120S/I127T/T130A/H188D, R29D/Y31L/Q33H/K36G/M38I/T41A/M43R/M47T/L70Q/E81V/L85R/K89N/A91T/F92P/K93V/R94L/I118V/T120S/I127T/T130A/K169E, R29D/Y31L/Q33H/K36G/M38I/T41A/M43R/M47T/L70Q/E81V/K89N/A91T/F92P/K93V/R94L/I118V/T120S/I127T/T130A, R29D/Y31L/Q33H/K36G/M38I/T41A/M43R/M47T/L85R/K89N/A91T/F92P/K93V/R94L/I118V/T120S/I127T/T130A/K169E/H188D, R29D/Y31L/Q33H/K36G/M38I/T41A/M43R/M47T/E81V/L85R/K89N/A91T/F92P/K93V/R94L/F108L/I118V/T120S/T130A/K169E/H188D, R29D/Y31L/Q33H/K36G/M38I/T41A/M43R/M47T/L70Q/E81V/L85R/K89N/A91T/F92P/K93V/R94L/I118V/T120S/T130A/N149D/K169E/H188D, H18L/R29D/Y31L/Q33H/K36G/M38I/T41A/M43R/M47T/L70Q/E81V/L85R/K89N/A91T/F92P/K93V/R94L/I118V/T120S/T130A/K169E/H188D, R29D/Y31L/Q33H/K36G/M38I/T41A/M43R/M47T/E81V/L85R/K89N/A91T/F92P/K93V/R94L/I118V/T120S/I127T/C128Y/T130A/H188D, H18L/R29D/Y31L/Q33H/K36G/M38I/T41A/M43R/M47T/E81V/L85R/K89N/A91T/F92P/K93V/R94L/E99D/T130A, H18L/R29D/Y31L/Q33H/K36G/M38I/T41A/M43R/M47T/L70Q/E81V/L85R/K89N/A91T/F92P/K93V/R94L/I118V/T120S/T130A/K169E, R29D/Y31L/Q33H/K36G/M38I/T41A/M43R/M47T/I61N/E81V/L85R/K89N/A91T/F92P/K93V/R94F/V104A/I118V/T120S/I126V/T130A, R29D/Y31L/Q33H/K36G/M38I/T41A/M43R/M47T/E81V/L85R/K89N/A91T/F92P/K93V/R94F/I118V/T120S/T130A, R29D/Y31L/Q33H/K36G/M38I/T41A/M43R/M47T/T62S/E81V/L85R/K89N/A91T/F92P/K93V/R94L/I118V/T120S/T130A/K169E/T175A, H18L/R29D/Y31L/Q33H/K36G/M38I/T41A/M43R/M47T/E81V/L85R/K89N/A91T/F92P/K93V/R94L/I118V/T120S/I127T/T130A/L142S/H188D, C16S/H18L/R29D/Y31L/Q33H/K36G/M38I/T41A/M43R/M47T/E81V/L85R/K89N/A91T/F92P/K93V/R94L/T110A/I118V/H188D, R29D/Y31L/Q33H/K36G/M38I/T41A/M43R/M47T/A91G/I118V/T120S/I127T/T130A/H188D, R29D/Y31L/Q33H/K36G/M38I/T41A/M43R/M47T/L70Q/D76G/A91G/S103L/I118V/T120S/I127T/T130A, Y53C/L85R/K89N/A91T/F92P/K93V/R94L/I118V/T120S/I127T/T130A/K169E, T62S/E81V/L85R/K89N/A91T/F92P/K93V/R94L/I118V/T120S/T130A/K169E, Y53C/L70Q/D90G/T130A/N149D/N152T/H188D, H18L/R29D/Y31L/Q33H/K36G/M38I/T41A/M43R/M47T/E81V/L85R/K89N/A91T/F92P/K93V/R94L/I118V/T120S/I127T/T130A/H188D, H18L/R29D/Y31L/Q33H/K36G/M38I/T41A/M43R/M47T/E81V/L85R/K89N/A91T/F92P/K93V/R94L/T130A/N149S.

In some embodiments, the variant CD80 polypeptide has one or more amino acid modifications (e.g., substitutions) in an unmodified CD80 or specific binding fragment there of corresponding to position(s) 4, 9, 10, 11, 12, 13, 14, 15, 16, 17, 18, 20, 21, 22, 24, 25, 27, 28, 29, 31, 33, 36, 37, 38, 40, 41, 42, 43, 44, 47, 48, 50, 52, 53, 54, 59, 60, 61, 62, 63, 64, 66, 67, 68, 69, 70, 72, 74, 76, 77, 80, 81, 83, 85, 86, 87, 88, 89, 90, 91, 92, 93, 94, 95, 96, 97, 99, 102, 103, 104, 108, 109, 110, 115, 116, 117, 118, 120, 121, 122, 126, 127, 128, 129, 130, 133, 137, 140, 142, 143, 144, 148, 149, 152, 154, 160, 162, 168, 169, 174, 175, 177, 178, 183, 178, 188, 190, 192, or 193 with reference to numbering of SEQ ID NO: 28. In some embodiments, such variant CD80 polypeptides exhibit altered binding affinity to one or more of CD28, PD-L1, or CTLA-4 compared to the wild-type or unmodified CD80 polypeptide. For example, in some embodiments, the variant CD80 polypeptide exhibits increased binding affinity to CD28, PD-L1, and/or CTLA-4 compared to a wild-type or unmodified CD80 polypeptide. In some embodiments, the variant CD80 polypeptide exhibits decreased binding affinity to CD28, PD-L1, and/or CTLA-4 compared to a wild-type or unmodified CD80 polypeptide.

In some embodiments, the variant CD80 polypeptide has one or more amino acid substitution selected from V4M, K9E, EO1R, V11S, A12G, A12T, A12V, T13N, L14A, S15V, S15F, C16S, C16G, C16L, G17W, H18L, H18R, H18Y, V20L, S21P, V22A, E24G, L25P, Q27R, T28A, T28S, R29C, R29D, R29H, R29V, Y31F, Y31H, Y31L, Q33H, K36E, K36G, K37E, K37Q, M38I, M38L, M38T, M38V, L40M, T41A, T41G, T41D, T41I, M42T, M43I, M43Q, M43R, M43V, S44P, M47T, N48I, W50G, E52G, Y53C, K54M, F59L, F59S, D60V, I61N, T62S, N63S, N64S, S66H, I67F, I67T, V68A, V68M, I69T, L70Q, L70P, L70R, L72P, P74L, D76G, E77G, E77K, Y80N, E81A, E81R, E81V, V83A, V83I, L85I, L85R, K86E, Y87N, E88D, E88G, K89E, K89N, K89R, D90K, D90L, D90N, A91E, A91G, A91S, A91T, F92L, F92N, F92P, F92Y, K93I, K93E, K93Q, K93R, K93V, R94G, R94L, R94F, E95K, H96R, L97R, E99G, L102S, S103L, S103P, V104A, V104L, F108L, P109S, P109H, T110A, D115G, F116S, F116L, E117V, E117G, I118V, I118A, I118T, T120S, S121P, N122S, I126L, I127T, C128Y, C128R, S129L, S129P, T130A, G133D, P137L, S140T, L142S, E143G, N144S, L148S, N149D, N149S, N152T, T154I, T154A, E160G, E162G, S168G, K169E, K169I, K169S, M174T, M174V, T175A, N177S, H178R, L183H, H188D, H188Q, R190S, N192D, Q193L. In some embodiments, the variant CD80 polypeptide has one or more amino acid substitutions selected from the group consisting of V4M, K9E, EO1R, V11S, A12G, A12T, A12V, T13N, L14A, S15V, S15F, C16S, C16G, C16L, G17W, H18L, H18R, H18Y, V20L, S21P, V22A, E24G, L25P, Q27R, T28A, T28S, R29C, R29D, R29H, R29V, Y31F, Y31H, Y31L, Q33H, K36E, K36G, K37E, K37Q, M38I, M38L, M38T, M38V, L40M, T41A, T41G, T41D, T41I, M42T, M43I, M43Q, M43R, M43V, S44P, M47T, N48I, W50G, E52G, Y53C, K54M, F59L, F59S, D60V, I61N, T62S, N63S, N64S, S66H, I67F, I67T, V68A, V68M, I69T, L70Q, L70P, L70R, L72P, P74L, D76G, E77G, E77K, Y80N, E81A, E81R, E81V, V83A, V83I, L85I, L85R, K86E, Y87N, E88D, E88G, K89E, K89N, K89R, D90K, D90L, D90N, A91E, A91G, A91S, A91T, F92L, F92N, F92P, F92Y, K93I, K93E, K93Q, K93R, K93V, R94G, R94L, R94F, E95K, H96R, L97R, E99G, L102S, S103L, S103P, V104A, V104L, F108L, P109S, P109H, T110A, D115G, F116S, F116L, E117V, E117G, I118V, I118A, I118T, T120S, S121P, N122S, I126L, I127T, C128Y, C128R, S129L, S129P, T130A, G133D, P137L, S140T, L142S, E143G, N144S, L148S, N149D, N149S, N152T, T154I, T154A, E160G, E162G, S168G, K169E, K169I, K169S, M174T, M174V, T175A, H178R, H178R, L183H, H188D, H188Q, R190S, N192D, Q193L, or a conservative amino acid substitution thereof.

In some embodiments, the variant CD80 polypeptide has one or more amino acid modifications (e.g., substitutions) in an unmodified CD80 or specific binding fragment there of corresponding to position(s) 30, 65, 107, 114, 164, 185, or 199 with reference to numbering of SEQ ID NO: 28. In some embodiments, the variant CD80 polypeptide has one or more amino acid substitution selected from I30V, N48D, L65H, E99D, D107N, S114T, I126V, N144D, Y164H, and T199S. In some embodiments, the variant CD80 polypeptide has one or more amino acid substitutions selected from the group consisting of N48D, L65H, E99D, D107N, S114T, I126V, N144D, Y164H, K185E, T199S, or a conservative amino acid substitution thereof.

A conservative amino acid substitution is any amino acid that falls in the same class of amino acids as the substituted amino acids, other than the wild-type or unmodified amino acid. The classes of amino acids are aliphatic (glycine, alanine, valine, leucine, and isoleucine), hydroxyl or sulfur-containing (serine, cysteine, threonine, and methionine), cyclic (proline), aromatic (phenylalanine, tyrosine, tryptophan), basic (histidine, lysine, and arginine), and acidic/amide (aspartate, glutamate, asparagine, and glutamine). Thus, for example, a conservative amino acid substitution of the V4M substitution includesV4S, V4C, and V4T amino acid substitutions.

In some embodiments, the variant CD80 polypeptide comprises any of the substitutions (mutations) listed in Table 1. Table 1 also provides exemplary sequences by reference to SEQ ID NO for the extracellular domain (ECD) or IgV domain of wild-type CD80 or exemplary variant CD80 polypeptides. As indicated, the exact locus or residues corresponding to a given domain can vary, such as depending on the methods used to identify or classify the domain. Also, in some cases, adjacent N- and/or C-terminal amino acids of a given domain (e.g. IgV) also can be included in a sequence of a variant IgSF polypeptide, such as to ensure proper folding of the domain when expressed. Thus, it is understood that the exemplification of the SEQ ID NOs in Table 1 is not to be construed as limiting. For example, the particular domain, such as the IgV domain, of a variant CD80 polypeptide can be several amino acids longer or shorter, such as 1-10, e.g. 1, 2, 3, 4, 5, 6 or 7 amino acids longer or shorter, than the sequence of amino acids set forth in the respective SEQ ID NO.

In some embodiments, the variant CD80 polypeptide comprises any of the extracellular domain (ECD) sequences listed in Table 1 (i.e., any one of SEQ ID NOS: 55-108, 280-346, 414-475). In some embodiments, the variant CD80 polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the extracellular domain (ECD) sequences listed in Table 1 (i.e., any one of SEQ ID NOS: 55-108, 280-346, 414-475) and contains the amino acid modification(s), e.g., substitution(s), not present in the wild-type or unmodified CD80. In some embodiments, the variant CD80 polypeptide comprises a specific binding fragment of any of the extracellular domain (ECD) sequences listed in Table 1 (i.e., any one of SEQ ID NOS: 55-108, 280-346, 414-475) and contains the amino acid modification(s), e.g., substitution(s), not present in the wild-type or unmodified CD80. In some embodiments, the variant CD80 polypeptide comprises any of the IgV sequences listed in Table 1 (i.e., any one of SEQ ID NOS: 153-195, 347, 373-386, 476-477). In some embodiments, the variant CD80 polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences listed in Table 1 (i.e., any one of SEQ ID NOS: 153-195, 347, 373-386, 476-477) and contains the amino acid modification(s), e.g., substitution(s), not present in the wild-type or unmodified CD80. In some embodiments, the variant CD80 polypeptide comprises a specific binding fragment of any of the IgV sequences listed in Table 1 (i.e., any one of SEQ ID NOS: 153-195, 347, 373-386, 476-477) and contains the amino acid modification(s), e.g., substitution(s), not present in the wild-type or unmodified CD80.

Table 1 also provides exemplary sequences by reference to SEQ ID NO for the extracellular domain (ECD) or IgV domain of wild-type CD80 or exemplary variant CD80 polypeptides. As indicated, the exact locus or residues corresponding to a given domain can vary, such as depending on the methods used to identify or classify the domain. Also, in some cases, adjacent N- and/or C-terminal amino acids of a given domain (e.g. ECD) also can be included in a sequence of a variant IgSF polypeptide, such as to ensure proper folding of the domain when expressed. Thus, it is understood that the exemplification of the SEQ ID NOSs in Table 1 is not to be construed as limiting. For example, the particular domain, such as the IgV domain, of a variant CD80 polypeptide can be several amino acids longer or shorter, such as 1-10, e.g. 1, 2, 3, 4, 5, 6 or 7 amino acids longer or shorter, than the sequence of amino acids set forth in the respective SEQ ID NO.

TABLE 1

Exemplary variant CD80 polypeptides

| Mutation(s) | ECD SEQ ID NO | IgV SEQ ID NO |
|---|---|---|
| Wild-type | 28 | 152, 372 |
| L70Q/A91G | 55 | 153, 374 |
| L70Q/A91G/T130A | 56 | |
| L70Q/A91G/I118A/T120S/T130A | 57 | |
| V4M/L70Q/A91G/T120S/T130A | 58 | 154 |
| L70Q/A91G/T120S/T130A | 59 | |
| V20L/L70Q/A91S/T120S/T130A | 60 | 155 |
| S44P/L70Q/A91G/T130A | 61 | 156 |
| L70Q/A91G/E117G/T120S/T130A | 62 | |
| A91G/T120S/T130A | 63 | 157 |
| L70R/A91G/T120S/T130A | 64 | 158 |
| L70Q/E81A/A91G/T120S/I127T/T130A | 65 | 159 |
| L70Q/Y87N/A91G/T130A | 66 | 160 |
| T28S/L70Q/A91G/E95K/T120S/T130A | 67 | 161 |
| N63S/L70Q/A91G/T120S/T130A | 68 | 162 |
| K36E/I67T/L70Q/A91G/T120S/T130A/N152T | 69 | 163 |
| E52G/L70Q/A91G/T120S/T130A | 70 | 164 |
| K37E/F59S/L70Q/A91G/T120S/T130A | 71 | 165 |
| A91G/S103P | 72 | 378 |
| K89E/T130A | 73 | 166, 385 |
| A91G | 74 | 154, 375 |
| D60V/A91G/T120S/T130A | 75 | 167 |
| K54M/A91G/T120S | 76 | 168 |
| M38T/L70Q/E77G/A91G/T120S/T130A/N152T | 77 | 169 |
| R29H/E52G/L70R/E88G/A91G/T130A | 78 | 170 |
| Y31H/T41G/L70Q/A91G/T120S/T130A | 79 | 171 |
| V68A/T110A | 80 | 172 |
| S66H/D90G/T110A/F116L | 81 | 173 |
| R29H/E52G/T120S/T130A | 82 | 174 |
| A91G/L102S | 83 | 386 |
| I67T/L70Q/A91G/T120S | 84 | 175 |
| L70Q/A91G/T110A/T120S/T130A | 85 | |
| M38V/T41D/M43I/W50G/D76G/V83A/K89E/T120S/T130A | 86 | 176 |
| V22A/L70Q/S121P | 87 | 177 |
| A12V/S15F/Y31H/T41G/T130A/P137L/N152T | 88 | 178 |
| I67F/L70R/E88G/A91G/T120S/T130A | 89 | 179 |
| E24G/L25P/L70Q/T120S | 90 | 180 |
| A91G/F92L/F108L/T120S | 91 | 181 |
| R29D/Y31L/Q33H/K36G/M38I/T41A/M43R/M47T/E81V/L85R/K89N/A91T/F92P/K93V/R94L/I118T/N149S | 92 | 182 |
| R29D/Y31L/Q33H/K36G/M38I/T41A/M43R/M47T/E81V/L85R/K89N/A91T/F92P/K93V/R94L/N144S/N149S | 93 | |
| R29D/Y31L/Q33H/K36G/M381/T41A/M42T/M43R/M47T/E81V/L85R/K89N/A91T/F92P/K93V/R94L/L148S/N149S | 94 | 183 |
| E24G/R29D/Y31L/Q33H/K36G/M38I/T41A/M43R/M47T/F59L/E81V/L85R/K89N/A91T/F92P/K93V/R94L/H96R/N149S/C182S | 95 | 184 |
| R29D/Y31L/Q33H/K36G/M38I/T41A/M43R/M47T/E81V/L85R/K89N/A91T/F92P/K93V/R94L/N149S | 96 | |
| R29V/M43Q/E81R/L85I/K89R/D90L/A91E/F92N/K93Q/R94G | 97 | 185, 376 |
| T41I/A91G | 98 | 186, 377 |
| K89R/D90K/A91G/F92Y/K93R/N122S/N177S | 99 | |
| K89R/D90K/A91G/F92Y/K93R | 100 | 187, 373 |
| K36G/K37Q/M38I/F59L/E81V/L85R/K89N/A91T/F92P/K93V/R94L/E99G/T130A/N149S | 101 | 188 |
| E88D/K89R/D90K/A91G/F92Y/K93R | 102 | 189, 379 |
| K36G/K37Q/M38I/L40M | 103 | 190, 380 |
| K36G | 104 | 191, 381 |
| R29H/Y31H/T41G/Y87N/E88G/K89E/D90N/A91G/P109S | 105 | 192 |
| A12T/H18L/M43V/F59L/E77K/P109S/I118T | 106 | 193 |
| R29V/Y31F/K36G/M38L/M43Q/E81R/V83I/L85I/K89R/D90L/A91E/F92N/K93Q/R94G | 107 | 194, 382 |
| V68M/L70P/L72P/K86E | 108 | 195, 383 |
| R29D/Y31L/Q33H/K36G/M38I/T41A/M43R/M47T/E81V/L85R/K89N/A91T/F92P/K93V/R94L/T120S/I127T/T130A/K169E | 280 | |
| R29D/Y31L/Q33H/K36G/M38I/T4IA/M43R/M47T/L70Q/E81V/L85R/K89N/A91T/F92P/K93V/R94L/T120S/I127T/T130A | 281 | |
| H18L/R29D/Y31L/Q33H/K36G/M38I/T41A/M43R/M47T/E81V/L85R/K89N/A91T/F92P/K93V/R94L/T120S/I127T/T130A/K169E | 282 | |

TABLE 1-continued

| Exemplary variant CD80 polypeptides | | |
|---|---|---|
| Mutation(s) | ECD SEQ ID NO | IgV SEQ ID NO |
| R29D/Y31L/Q33H/K36G/M38I/T41A/M43R/M47T/E81V/L85R/K89N/A91T/F92P/K93V/R94L/T120S/T130A/M174T | 283 | |
| R29D/Y31L/Q33H/K36G/M38I/T41A/M43R/M47T/F59L/E81V/L85R/K89N/A91T/F92P/K93V/R94L/T120S/I127T/T130A/H188D | 284 | |
| H18R/R29D/Y31L/Q33H/K36G/K37E/M38I/T41A/M43R/M47T/L70Q/E81V/L85R/K89N/A91T/F92P/K93V/R94L/T120S/T130A/K169E/H188D | 285 | |
| R29D/Y31L/Q33H/K36G/M38I/T41A/M43R/M47T/L70Q/E81V/L85R/K89N/A91T/F92P/K93V/R94L/T120S/I127T/T130A/E143G/K169E/M174V/H188D | 286 | |
| R29D/Y31L/Q33H/K36G/M38I/T41A/M43R/M47T/L70Q/E81V/L85R/K89N/A91T/F92P/K93V/R94L/T120S/I127T/T130A | 287 | |
| R29D/Y31L/Q33H/K36G/M38I/T41A/M43R/M47T/E81V/L85R/K89N/A91T/F92P/K93V/R94L/T120S/I127T/T130A/H188D | 288 | |
| R29D/Y31L/Q33H/K36G/M38I/T4IA/M43R/M47T/L70Q/E81V/L85R/K89N/A91T/F92P/K93V/R94L/T120S/I127T/T130A/K169E | 289 | |
| R29D/Y31L/Q33H/K36G/M38I/T4IA/M43R/M47T/L70Q/E81V/L85R/K89N/A91T/F92P/K93V/R94L/T120S/I127T/T130A | 290 | |
| R29D/Y31L/Q33H/K36G/M38I/T41A/M43R/M47T/L85R/K89N/A91T/F92P/K93V/R94L/T120S/I127T/T130A/K169E/H188D | 291 | |
| R29D/Y31L/Q33H/K36G/M38I/T41A/M43R/M47T/E81V/L85R/K89N/A91T/F92P/K93V/R94L/F108L/T120S/T130A/K169E/H188D | 292 | |
| R29D/Y31L/Q33H/K36G/M38I/T41A/M43R/M47T/L70Q/E81V/L85R/K89N/A91T/F92P/K93V/R94L/T130A/H188D | 293 | |
| R29D/Y31L/Q33H/K36G/M38I/T41A/M43R/M47T/L70Q/E81V/L85R/K89N/A91T/F92P/K93V/R94L/T120S/I127T/T130A/K169E | 294 | |
| H18L/R29D/Y31L/Q33H/K36G/M38I/T41A/M43R/M47T/L70Q/E81V/L85R/K89N/A91T/F92P/K93V/R94L/T120S/T130A/K169E/H188D | 295 | |
| R29D/Y31L/Q33H/K36G/M38I/T41A/M43R/M47T/E81V/L85R/K89N/A91T/F92P/K93V/R94L/T120S/I127T/C128Y/T130A/H188D | 296 | |
| R29D/Y31L/Q33H/K36G/M38I/T41A/M43R/M47T/E81V/L85R/K89N/A91T/F92P/K93V/R94F/T130A/K169E | 297 | |
| H18L/R29D/Y31L/Q33H/K36G/M38I/T41A/M43R/M47T/E81V/L85R/K89N/A91T/F92P/K93V/R94L/T130A | 298 | |
| H18L/R29D/Y31L/Q33H/K36G/M38I/T41A/M43R/M47T/L70Q/E81V/L85R/K89N/A91T/F92P/K93V/R94L/T120S/T130A/K169E | 299 | |
| R29D/Y31L/Q33H/K36G/M38I/T41A/M43R/M47T/L70Q/E81V/L85R/K89N/A91T/F92P/K93I/R94L/L97R/T130A | 300 | |
| R29D/Y31L/Q33H/K36G/M38I/T41A/M43R/M47T/L70Q/E81V/L85R/K89N/A91T/F92P/K93I/R94L/L97R/T130A/L148S | 301 | |
| H18L/R29D/Y31L/Q33H/K36G/M38I/T41A/M43R/M47T/E81V/L85R/K89N/A91T/F92P/K93V/R94L/I118V/T120S/I127T/T130A/K169E | 302 | |
| R29D/Y31L/Q33H/K36G/M38I/T41A/M43R/M47T/I61N/E81V/L85R/K89N/A91T/F92P/K93V/R94F/V104A/T120S/T130A | 303 | |
| R29D/Y31L/Q33H/K36G/M38I/T41A/M43R/M47T/E81V/L85R/K89N/F92P/K93V/R94F/I118V/T130A | 304 | |
| R29D/Y31L/Q33H/K36G/M38I/T41A/M43R/M47T/T62S/E81V/L85R/K89N/A91T/F92P/K93V/R94L/I118V/T120S/T130A/K169E/T175A | 305 | |
| H18L/R29D/Y31L/Q33H/K36G/M38I/T41A/M43R/M47T/E81V/L85R/K89N/A91T/F92P/K93V/R94L/F116S/T130A/H188D | 306 | |
| H18L/R29D/Y31L/Q33H/K36G/M38I/T41A/M43R/M47T/E81V/L85R/K89N/A91T/F92P/K93V/R94L/T120S/I127T/T130A/L142S/H188D | 307 | |
| C16S/H18L/R29D/Y31L/Q33H/K36G/M38I/T41A/M43R/M47T/E81V/L85R/K89N/A91T/F92P/K93V/R94L/T110A/H188D | 308 | |
| R29D/Y31L/Q33H/K36G/M38I/T41A/M43R/M47T/A91G/T120S/I127T/T130A/H188D | 309 | |
| R29D/Y31L/Q33H/K36G/M38I/T41A/M43R/M47T/L70Q/D76G/A91G/S103L/T120S/I127T/T130A | 310 | |
| DELTAQ33/Y53C/L85R/K89N/A91T/F92P/K93V/R94L/T120S/I127T/T130A/K169E | 311 | |
| T62S/E81V/L85R/K89N/A91T/F92P/K93V/R94L/T120S/T130A/K169E | 312 | |
| R29D/Y31L/Q33H/K36G/M38I/T41A/M43R/M47T/E81V/L85R/K89N/A91T/F92P/K93V/R94L/S129L/H188D | 313 | |
| K9E/E10R/V11S/A12G/T13N/K14A/S15V/C16L/G17W/H18Y/Y53C/L70Q/D90G/T130A/N149D/N152T/H188D | 314 | |
| H18L/R29D/Y31L/Q33H/K36G/T41A/M43R/M47T/E81V/L85R/K89N/A91T/F92P/K93V/R94L/I118V/T120S/I127T/T130A/H188D | 315 | |
| K89E/K93E/T130A | 316 | |
| S21P/R29D/Y31L/Q33H/K36G/M38I/T41A/M43R/M47T/N48I/V68A/E81V/L85R/K89N/A91T/F92P/K93V/R94L/P109H/I126L/K169I | 317 | |
| H18L/R29D/Y31L/Q33H/K36G/M38I/T41A/M43R/M47T/P74L/Y80N/E81V/L85R/K89N/A91T/F92P/K93V/R94L/L97R | 318 | 347, 384 |
| S21P/R29D/Y31L/Q33H/K36G/M38I/T41A/M43R/M47T/P74L/Y80N/E81V/L85R/K89N/D90N/A91T/F92P/K93V/R94L/T130A/N149S/E162G | 319 | |

TABLE 1-continued

| Exemplary variant CD80 polypeptides | | |
|---|---|---|
| Mutation(s) | ECD SEQ ID NO | IgV SEQ ID NO |
| H18L/R29D/Y31L/Q33H/K36G/M38I/T41A/M43R/M47T/V68M/E81V/L85R/K89N/A91T/F92P/K93V/R94L/T130A | 320 | |
| R29D/Y31L/Q33H/K36G/M38I/T41A/M43R/M47T/V68M/E81V/L85R/K89N/A91T/F92P/K93V/R94L/T130A/N149S/R190S | 321 | |
| H18L/R29D/Y31L/Q33H/K36G/M38I/T41A/M43R/M47T/P74L/Y80N/E81V/L85R/K89N/A91T/F92P/K93V/R94L/T130A/R190S | 322 | |
| C16G/V22A/R29D/Y31L/Q33H/K36G/M38I/T41A/M43R/M47T/V68M/D76G/E81V/L85R/K89N/A91T/F92P/K93V/R94L/I118T/T130A/S140T/N149S/K169I/H178R/N192D | 323 | |
| R29D/Y31L/Q33H/K36G/M38I/T41A/M43R/M47T/E81V/L85R/K89N/A91T/F92P/K93V/R94F/E117V/I118T/N149S/S168G/H188Q | 324 | |
| V22A/R29D/Y31L/Q33H/K36G/M38I/T41A/M43R/M47T/V68M/E81V/L85R/K89N/A91T/F92P/K93V/R94L/T130A | 325 | |
| R29D/Y31L/Q33H/K36G/M38I/T41A/M43R/M47T/N64S/E81V/L85R/K89N/A91T/F92P/K93V/R94F/I118T/T130A/N149S/K169I | 326 | |
| V22A/R29D/Y31L/Q33H/K36G/M38I/T41A/M43R/M47T/V68M/E81V/L85R/K89N/A91T/F92P/K93V/R94L/D115G/I118T/T130A/G133D/N149S | 327 | |
| S129P | 328 | |
| A91G/S129P | 329 | |
| I69T/L70Q/A91G/T120S | 330 | |
| Y31H/S129P | 331 | |
| T28A/R29D/Y31L/Q33H/K36G/M38I/T41A/M43R/M47T/E81V/L85R/K89N/A91T/F92P/K93V/R94L/V104L/T130A/N149S | 332 | |
| H18L/R29D/Y31L/Q33H/K36G/M38I/T41A/M43R/M47T/E81V/L85R/K89N/A91T/F92P/K93V/R94L/L97R/N149S/H188Q | 333 | |
| H18L/R29D/Y31L/Q33H/K36G/M38I/T41A/M43R/M47T/E81V/L85R/K89N/A91T/F92P/K93V/R94L/L97R/N149S | 334 | |
| H18L/R29D/Y31L/Q33H/K36G/M381/T41A/M43R/M47T/V68A/E81V/L85R/K89N/A91T/F92P/K93V/R94L/T130A/N149S/T154I | 335 | |
| A12G/R29D/Y31L/Q33H/K36G/M38PT41A/M43R/M47T/V68A/E81V/L85R/K89N/A91T/F92P/K93V/R94L/L97R/T130A/L183H | 336 | |
| R29D/Y31L/Q33H/K36G/M38I/T41A/M43R/M47T/E81V/L85R/K89N/A91T/F92P/K93V/R94L/I118T/T130A/S140T/N149S/K169S | 337 | |
| R29D/Y31L/Q33H/K36G/M38I/T41A/M43R/M47T/E81V/L85R/K89N/A91T/F92P/K93V/R94L/I118T/T130A/N149S/K169I/Q193L | 338 | |
| V22A/R29D/Y31L/Q33H/K36G/M38I/T41A/M43R/M47T/E81V/L85R/K89N/A91T/F92P/K93V/R94L/I118T/T130A/N149S | 339 | |
| R29D/Y31L/Q33H/K36G/M38I/T41A/M43R/M47T/E81V/L85R/K89N/A91T/F92P/K93V/R94L/I118T/T130A/N149S | 340 | |
| R29D/Y31L/Q33H/K36G/M38I/T41A/M43R/M47T/E81V/L85R/K89N/A91T/F92P/K93V/R94L/I118T/T130A/N149S/K169I | 341 | |
| R29D/Y31L/Q33H/K36G/M38I/T41A/M43R/M47T/E81V/L85R/K89N/A91T/F92P/K93V/R94F/T130A/N149S/K169I | 342 | |
| I118T/C128R | 343 | |
| Q27R/R29C/M42T/S129P/E160G | 344 | |
| S129P/T154A | 345 | |
| S21P/L70Q/D90G/T120S/T130A | 346 | |
| L70Q/A91G/N144D | 414 | |
| L70Q/A91G/I118A/T120S/T130A/K169E | 415 | |
| V4M/L70Q/A91G/I118V/T120S/T130A/K169E | 416 | |
| L70Q/A91G/I118V/T120S/T130A/K169E | 417 | |
| L70Q/A91G/I118V/T120S/T130A | 418 | |
| V20L/L70Q/A91S/I118V/T120S/T130A | 419 | |
| L70Q/A91G/E117G/I118V/T120S/T130A | 420 | |
| A91G/I118V/T120S/T130A | 421 | |
| L70R/A91G/I118V/T120S/T130A/T199S | 422 | |
| L70Q/E81A/A91G/I118V/T120S/I127T/T130A | 423 | |
| T28S/L70Q/A91G/E95K/I118V/T120S/I126V/T130A/K169E | 424 | |
| N63S/L70Q/A91G/S114T/I118V/T120S/T130A | 425 | |
| K36E/I67T/E70Q/A91G/I118V/T120S/T130A/N152T | 426 | |
| E52G/L70Q/A91G/D107N/I118V/T120S/T130A/K169E | 427 | |
| K37E/F59S/L70Q/A91G/I118V/T120S/T130A/K185E | 428 | |
| D60V/A91G/I118V/T120S/T130AK169E | 429 | |
| K54M/L70Q/A91G/Y164H/T120S | 430 | |
| M38T/L70Q/E77G/A91G/I118V/T120S/T130A/N152T | 431 | |
| Y31H/T41G/M43L/L70Q/A91G/I118V/T120S/I126V/T130A | 432 | |
| L65H/D90G/T110A/F116L | 433 | |
| R29H/E52G/D90N/I118V/T120S/T130A | 434 | |
| I67T/L70Q/A91G/I118V/T120S | 436 | |
| L70Q/A91G/T110A/I118V/T120S/T130A | 437 | |
| M38V/T41D/M43I/W50G/D76G/V83A/K89E/I118V/T120S/I126V/T130A | 438 | |
| A12V/S15F/Y31H/M38L/T41G/M43L/D90N/T130A/P137L/N149D/N152T | 439 | |
| I67F/L70R/E88G/A91G/I118V/T120S/T130A | 440 | |
| E24G/L25P/L70Q/A91G/I118V/T120S/N152T | 441 | |
| A91G/F92L/F108L/I118V/T120S | 442 | |

TABLE 1-continued

| Exemplary variant CD80 polypeptides | | |
|---|---|---|
| Mutation(s) | ECD SEQ ID NO | IgV SEQ ID NO |
| E88D/K89R/D90K/A91G/F92Y/K93R/N122S/N177S | 443 | |
| K36G/K37Q/M38I/L40M/F59L/E81V/L85R/K89N/A91T/F92P/K93V/R94L/E99G/T130A/N149S | 444 | |
| K36G/L40M | 445 | 476, 477 |
| R29D/Y31L/Q33H/K36G/M38I/T41A/M43R/M47T/E81V/L85R/K89N/A91T/F92P/K93V/R94L/I118V/T120S/I127T/T130A/K169E | 446 | |
| R29D/Y31L/Q33H/K36G/M38I/T41A/M43R/M47T/L70Q/E81V/L85R/K89N/A91T/F92P/K93V/R94L/I118V/T120S/I127T/T130A | 447 | |
| H18L/R29D/Y31L/Q33H/K36G/M38I/T41A/M43R/M47T/E81V/L85R/K89N/A91T/F92P/K93V/R94L/I118V/T120S/I127T/T130A/K169E | 448 | |
| R29D/Y31L/Q33H/K36G/M38I/T41A/M43R/M47T/E81V/L85R/K89N/A91T/F92P/K93V/R94L/I118V/T120S/T130A/K169E/M174T | 449 | |
| R29D/Y31L/Q33H/K36G/M38I/T41A/M43R/M47T/N48D/F59L/E81V/L85R/K89N/A91T/F92P/K93V/R94L/I118V/T120S/I127T/T130A/H188D | 450 | |
| H18R/R29D/Y31L/Q33H/K36G/K37E/M38I/T41A/M43R/M47T/E70Q/E81V/L85R/K89N/A91T/F92P/K93V/R94L/I118V/T120S/T130A/K169E/H188D | 451 | |
| R29D/Y31L/Q33H/K36G/M38I/T41A/M43R/M47T/L70Q/E81V/L85R/K89N/A91T/F92P/K93V/R94L/I118V/T120S/I127T/T130A/E143G/K169E/M174V/H188D | 452 | |
| R29D/I30V/Y31L/Q33H/K36G/M38I/T41A/M43R/M47T/E81V/L85R/K89N/A91T/F92P/K93V/R94L/I118V/T120S/I127T/T130A/H188D | 453 | |
| R29D/Y31L/Q33H/K36G/M38I/T41A/M43R/M47T/E81V/L85R/K89N/A91T/F92P/K93V/R94L/I118V/T120S/I127T/T130A/H188D | 454 | |
| R29D/Y31L/Q33H/K36G/M38I/T41A/M43R/M47T/L70Q/E81V/L85R/K89N/A91T/F92P/K93V/R94L/I118V/T120S/I127T/T130A/K169E | 455 | |
| R29D/Y31L/Q33H/K36G/M38I/T41A/M43R/M47T/L70Q/E81V/K89N/A91T/F92P/K93V/R94L/I118V/T120S/I127T/T130A | 456 | |
| R29D/Y31L/Q33H/K36G/M38I/T41A/M43R/M47T/L85R/K89N/A91T/F92P/K93V/R94L/I118V/T120S/I127T/T130A/K169E/H188D | 457 | |
| R29D/Y31L/Q33H/K36G/M38I/T41A/M43R/M47T/E81V/L85R/K89N/A91T/F92P/K93V/R94L/F108L/I118V/T120S/T130A/K169E/H188D | 458 | |
| R29D/Y31L/Q33H/K36G/M38I/T41A/M43R/M47T/E70Q/E81V/L85R/K89N/A91T/F92P/K93V/R94L/I118V/T120S/T130A/N149D/K169E/H188D | 459 | |
| H18E/R29D/Y31L/Q33H/K36G/M38I/T41A/M43R/M47T/E70Q/E81V/L85R/K89N/A91T/F92P/K93V/R94L/I118V/T120S/T130A/K169E/H188D | 460 | |
| R29D/Y31L/Q33H/K36G/M38I/T41A/M43R/M47T/E81V/L85R/K89N/A91T/F92P/K93V/R94L/I118V/T120S/I127T/C128Y/T130A/H188D | 461 | |
| H18E/R29D/Y31L/Q33H/K36G/M38I/T41A/M43R/M47T/E81V/L85R/K89N/A91T/F92P/K93V/R94L/E99D/T130A | 462 | |
| H18E/R29D/Y31L/Q33H/K36G/M38I/T41A/M43R/M47T/E70Q/E81V/L85R/K89N/A91T/F92P/K93V/R94L/I118V/T120S/T130A/K169E | 463 | |
| R29D/Y31L/Q33H/K36G/M38I/T41A/M43R/M47T/I61N/E81V/L85R/K89N/A91T/F92P/K93V/R94F/V104A/I118V/T120S/I126V/T130A | 464 | |
| R29D/Y31L/Q33H/K36G/M38I/T41A/M43R/M47T/E81V/L85R/K89N/A91T/F92P/K93V/R94F/I118V/T120S/T130A | 465 | |
| R29D/Y31L/Q33H/K36G/M38I/T41A/M43R/M47T/T62S/E81V/L85R/K89N/A91T/F92P/K93V/R94L/I118V/T120S/T130A/K169E/T175A | 466 | |
| H18L/R29D/Y31L/Q33H/K36G/M38I/T41A/M43R/M47T/E81V/L85R/K89N/A91T/F92P/K93V/R94L/I118V/T120S/I127T/T130A/E142S/H188D | 467 | |
| C16S/H18L/R29D/Y31L/Q33H/K36G/M38I/T41A/M43R/M47T/E81V/L85R/K89N/A91T/F92P/K93V/R94L/T110A/I118V/H188D | 468 | |
| R29D/Y31L/Q33H/K36G/M38I/T41A/M43R/M47T/A91G/I118V/T120S/I127T/T130A/H188D | 469 | |
| R29D/Y31L/Q33H/K36G/M38I/T41A/M43R/M47T/L70Q/D76G/A91G/S103L/I118V/T120S/I127T/T130A | 470 | |
| Y53C/L85R/K89N/A91T/F92P/K93V/R94L/I118V/T120S/I127T/T130A/K169E | 471 | |
| T62S/E81V/L85R/K89N/A91T/F92P/K93V/R94L/I118V/T120S/T130A/K169E | 472 | |
| Y53C/E70Q/D90G/T130A/N149D/N152T/H188D | 473 | |
| H18L/R29D/Y31L/Q33H/K36G/M38I/T41A/M43R/M47T/E81V/L85R/K89N/A91T/F92P/K93V/R94L/I118V/T120S/I127T/T130A/H188D | 474 | |
| H18L/R29D/Y31L/Q33H/K36G/M38I/T41A/M43R/M47T/E81V/L85R/K89N/A91T/F92P/K93V/R94L/T130A/N149S | 475 | |

In some embodiments the variant CD80 polypeptide has one or more amino acid modifications (e.g., substitutions) corresponding to position(s) 12, 18, 20, 29, 31, 36, 40, 41, 43, 52, 59, 60, 63, 67, 70, 77, 81, 87, 88, 89, 90, 91, 92, 93, 107, 109, 114, 117, 118, 120, 122, 127, 130, 144, 169, 178 or 199 of SEQ ID NO: 28. In some embodiments, the variant CD80 polypeptide has one or more amino acid substitutions selected from A12T, H18L, V20L, R29H, Y31H, K36G, L40M, T41G, T41I, M43V, E52G, F59L, D60V, N63S, I67T, L70Q, L70R, E77K, E81A, Y87N, E88D, E88G, K89E, K89R, D90K, D90N, A91G, A91S, F92Y, K93R, D107N, P109S, S114T, E117G, I118A, I118T, I118V, T120S, I127T, T130A, N144D, K169E, H178R, or T199S. In some embodiments, the variant CD80 polypeptide has one or more amino acid substitutions selected from A12T, H18L, V20L, R29H, Y31H, K36G, L40M, T41G, T41I, M43V, E52G, F59L, D60V, N63S, I67T, L70Q, L70R, E77K, E81A, Y87N, E88D, E88G, K89E, K89R, D90K, D90N, A91G, A91S, F92Y, K93R, D107N, P109S, S114T, E117G, I118A, I118T, I118V, T120S, I127T, T130A, N144D, K169E, H178R, or T199S or conservative amino acid substitutions thereof. In some embodiments, the one or more amino acid substitutions is A12T/H18L/M43V/F59L/E77K/P109S/I118T, V20L/L70Q/A91S/T120S/T130A, V20L/L70Q/A91S/I118V/T120S/T130A, R29H/Y31H/T41G/Y87N/E88G/K89E/D90N/A91G/P109S, K36G, K36G/L40M, T41I/A91G, E52G/L70/A91G/T120S/T130A, E52G/L70Q/A91G/D107N/I118V/T120S/T130A/K169E, D60V/A91G/T120S/T130A, D60V/A91G/I118V/T120S/T130A/K169E, N63S/L70Q/A91G/T120S/T130A, N63S/L70Q/A91G/S114T/I118V/T120S/T130A, I67T/L70Q/A91G/T120S, I67T/L70Q/A91G/I118V/T120S, L70Q/E81A/A91G/T120S/I127T/T130A, L70Q/E81A/A91G/I118V/T120S/I127T/T130A, L70Q/Y87N/A91G/T130A, L70Q/A91G, L70Q/A91G/N144D, L70Q/A91G/E117G/T120S/T130A, L70Q/A91G/E117G/I118V/T120S/T130A, L70Q/A91G/I118A/T120S/T130A, L70Q/A91G/I118A/T120S/T130A/K169E, L70Q/A91G/T120S/T130A, L70Q/A91G/I118V/T120S/T130A/K169E, L70R/A91G/T120S/T130A, L70R/A91G/I118V/T120S/T130A/T199S, E88D/K89R/D90K/A91G/F92Y/K93R, K89R/D90K/A91G/F92Y/K93R, or K89R/D90K/A91G/F92Y/K93R/N122S/N177S, E88D/K89R/D90K/A91G/F92Y/K93R/N122S/N177S. In some embodiments, the variant CD80 polypeptide exhibits increased affinity for the ectodomain of CD28 and/or increased selectivity to CD28 compared to a wild-type or unmodified CD80 polypeptide, such as comprising the sequence set forth in SEQ ID NO: 28, 152, or 372.

In some embodiments, the variant CD80 polypeptide has one or more amino acid modifications (e.g., substitutions) that correspond to position(s) 12, 18, 21, 22, 28, 29, 31, 33, 36, 38, 40, 41, 42, 43, 47, 48, 59, 64, 67, 68, 70, 77, 81, 85, 87, 88, 89, 90, 91, 92, 93, 94, 97, 104, 109, 115, 117, 118, 120, 122, 126, 130, 133, 140, 144, 148, 149, 168, 169, 177, 183, 188 or 193. of SEQ ID NO: 28. In some embodiments, the variant CD80 polypeptide has one or more amino acid substitutions selected from the group consisting of A12G, A12T, H18L, S21P, V22A, T28A, R29D, R29H, Y31H, Y31L, Q33H, K36G, M38I, L40M, T41A, T41G, M42T, M43R, M43V, M47T, N48I, F59L, N64S, I67T, V68A, V68M, L70Q, E77K, E81V, L85R, Y87N, E88D, E88G, K89E, K89N, K89R, D90K, D90N, A91G, A91T, F92P, F92Y, K93R, K93V, R94F, R94L, L97R, V104L, P109H, P109S, D115G, E117V, 118T, 118V, T120S, N122S, I126L, T130A, G133D, S140T, N144S, L148S, N149S, S168G, K169I, K169S, N177S, L183H, H188Q, R190S and Q193L. In some embodiments, the variant CD80 polypeptide has one or more amino acid substitutions selected from the group consisting of A12T, H18L, R29D, R29H, Y31H, Y31L, Q33H, K36G, M38I, L40M, T41A, T41G, M42T, M43R, M43V, M47T, F59L, I67T, L70Q, E77K, E81V, L85R, Y87N, E88D, E88G, K89E, K89N, K89R, D90K, D90N, A91G, A91T, F92P, F92Y, K93R, K93V, R94L, P109S, I118T, I118V, T120S, N122S, N144S, L148S, N149S, and N178S, and conservative amino acid substitutions thereof.

In some embodiments, the one or more amino acid substitutions is A12T/H18L/M43V/F59L/E77K/P109S/I118T, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144S/N149S, R29D/Y31L/Q33H/K36G/M38I/T41A/M42T/M43R/M47T/E81V/L85R/K89N/A91T/F92P/K93V/R94L/L148S/N149S, R29D/Y31L/Q33H/K36G/M38I/T41A/M43R/M47T/E81V/L85R/K89N/A91T/F92P/K93V/R94L/N149S, R29H/Y31H/T41G/Y87N/E88G/K89E/D90N/A91G/P109S, K36G, K36G/L40M, I67T/L70Q/A91G/T120S, I67T/L70Q/A91G/I118V/T120S, E88D/K89R/D90K/A91G/F92Y/K93R, K89R/D90K/A91G/F92Y/K93R, A91G, H18L/R29D/Y31L/Q33H/K36G/M38I/T41A/M43R/M47T/E81V/L85R/K89N/A91T/F92P/K93V/R94L/I118V/T120S/I127T/T130A/H188D, R29D/Y31L/Q33H/K36G/M38I/T41A/M43R/M47T/V68M/E81V/L85R/K89N/A91T/F92P/K93 V/R94L/T130A/N149S/R190S, R29D/Y31L/Q33H/K36G/M38I/T41A/M43R/M47T/E81V/L85R/K89N/A91T/F92P/K93V/R94F/E117V/I118T/N149S/S168G/H188Q, V22A/R29D/Y31L/Q33H/K36G/M38I/T41A/M43R/M47T/V68M/E81V/L85R/K89N/A91T/F92P/K93V/R94L/T130A, R29D/Y31L/Q33H/K36G/M38I/T41A/M43R/M47T/N64S/E81V/L85R/K89N/A91T/F92P/K93V/R94F/I118T/T130A/N149S/K169I, V22A/R29D/Y31L/Q33H/K36G/M38I/T41A/M43R/M47T/V68M/E81V/L85R/K89N/A91T/F92P/K93V/R94L/D115G/I118T/T130A/G133D/N149S, T28A/R29D/Y31L/Q33H/K36G/M38I/T41A/M43R/M47T/E81V/L85R/K89N/A91T/F92P/K93V/R94L/V104L/T130A/N149S, H18L/R29D/Y31L/Q33H/K36G/M38I/T41A/M43R/M47T/E81V/L85R/K89N/A91T/F92P/K93V/R94L/L97R/N149S/H188Q, K89E/T130A, K89E/K93E/T130A, S21P/R29D/Y31L/Q33H/K36G/M38I/T41A/M43R/M47T/N48I/V68A/E81V/L85R/K89N/A91T/F92P/K93V/R94L/S21P/N48I/V68A/P109H/I126L/K169I, H18L/R29D/Y31L/Q33H/K36G/M38I/T41A/M43R/M47T/V68M/E81V/L85R/K89N/A91T/F92P/K93V/R94L/T130A, H18L/R29D/Y31L/Q33H/K36G/M38I/T41A/M43R/M47T/E81V/L85R/K89N/A91T/F92P/K93V/R94L/T130A/N149S, A12G/R29D/Y31L/Q33H/K36G/M38I/T41A/M43R/M47T/V68A/E81V/L85R/K89N/A91T/F92P/K93V/R94L/L97R/T130A/L183H, R29D/Y31L/Q33H/K36G/M38I/T41A/M43R/M47T/E81V/L85R/K89N/A91T/F92P/K93V/R94L/I118T/T130A/S140T/N149S/K169S, R29D/Y31L/Q33H/K36G/M38I/T41A/M43R/M47T/E81V/L85R/K89N/A91T/F92P/K93V/R94L/I118T/T130A/N149S/K169I/Q193L, V22A/R29D/Y31L/Q33H/K36G/M38I/T41A/M43R/M47T/E81V/L85R/K89N/A91T/F92P/K93V/R94L/I118T/T130A/N149S, R29D/Y31L/Q33H/K36G/M38I/T41A/M43R/M47T/E81V/L85R/K89N/A91T/F92P/K93V/R94L/I118T/T130A/N149S, R29D/Y31L/Q33H/K36G/M38I/T41A/M43R/M47T/E81V/L85R/K89N/A91T/F92P/K93V/R94L/I118T/T130A/N149S/K169I, or R29D/Y31L/Q33H/K36G/M38I/T41A/M43R/M47T/E81V/L85R/K89N/A91T/F92P/K93V/R94 F/T130A/N149S/K169I. In some embodiments, the variant CD80 polypeptide exhibits increased affinity to PD-L1 and/or increased selectivity to PD-L1 compared to the wild-type or unmodified CD80 polypeptide, such as comprising the sequence set forth in SEQ ID NO: 28, 152, or 372.

In some embodiments, the variant CD80 polypeptide has one or more amino acid modifications (e.g., substitutions) that correspond to position(s) 12, 18, 36, 40, 43, 59, 77, 88, 89, 90, 91, 92, 93, 109, 118, 122, or 177 of SEQ ID NO: 28. In some embodiments, the variant CD80 polypeptide has one or more amino acid substitutions selected from the group consisting of A12T, H18L, K36G, M43V, F59L, E77K, E88D, K89R, D90K, A91G, F92Y, K93R, P109S, I118T, N112S, and N177S. In some embodiments, the variant CD80 polypeptide has one or more amino acid substitutions selected from the group consisting of A12T, H18L, K36G, L40M, M43V, F59L, E77K, E88D, K89R, D90K, A91G, F92Y, K93R, P109S, I118T, N112S, and N177S, and conservative mutations thereof. In some embodiments, the one or more amino acid substitution is A12T/H18L/M43V/F59L/E77K/P109S/I118T, K36G, K36G/L40M, E88D/K89R/D90K/A91G/F92Y/K93R, K89R/D90K/A91G/F92Y/K93R, E88D/K89R/D90K/A91G/F92Y/K93R/N122S/N177S, or K89R/D90K/A91G/F92Y/K93R/N122S/N177S. In some embodiments, the variant CD80 polypeptide exhibits increased affinity to the ectodomain of CD28 and the ectodomain of PD-L1 compared to a wildtype or unmodified CD80 polypeptide, such as comprising the sequence set forth in SEQ ID NO: 28, 152, or 372.

In some embodiments, the variant CD80 polypeptide has one or more amino acid modifications (e.g., substitutions) corresponding to position(s) 4, 29, 31, 36, 40, 41, 52, 67, 68, 70, 87, 88, 89, 90, 91, 92, 93, 107, 109, 110, 118, 120, 130, 144, or 169 of SEQ ID NO: 28. In some embodiments, the variant CD80 polypeptide has one or more amino acid substitutions selected from the group consisting of V4M, R29H, Y31H, K36G, L40M, T41G, E52G, I67T, V68A, L70Q, Y87N, E88D, E88G, K89E, K89R, D90K, D90N, A91G, F92Y, K93R, D107N, P109S, T110A, I118V, T120S, T130A, N144D, and K169E. In some embodiments, the variant CD80 polypeptide has one or more amino acid substitutions selected from the group consisting of V4M, R29H, Y31H, K36G, L40M, T41I, T41G, E52G, I67T, I69T, V68A, L70Q, Y87N, E88D, E88G, K89E, K89R, D90K, D90N, A91G, F92Y, K93R, D107N, P109S, T110A, I118V, T120S, T130A, N144D, and K169E and conservative amino acid substitutions thereof. In some embodiments, the one or more amino acid substitution is V4M/L70Q/A91G/T120S/T130A, V4M/L70Q/A91G/I118V/T120S/T130A/K169E, R29H/Y31H/T41G/Y87N/E88G/K89E/D90N/A91G/P109S, K36G, K36G/L40M, T41 I/A91G, E52G/L70Q/A91G/T120S/T130A, E52G/L70Q/A91G/D107N/I118V/T120S/T130A/K169E, I67T/L70Q/A91G/T120S, I67T/L70Q/A91G/I118V/T120S, V68A/T110A, L70Q/A91G, L70Q/A91G/N144D, L70Q/A91G/T120S/T130A, L70Q/A91G/I118V/T120S/T130A/K169E, L70Q/A91G/T130A, K89R/D90K/A91G/F92Y/K93R, E88D/K89R/D90K/A91G/F92Y/K93R, A91G/I118V/T120S/T130A, A91G/T120S/T130A or I69T/L70Q/A91G/T120S. In some embodiments, the variant CD80 polypeptide exhibits increased affinity and/or increased selectivity to the ectodomain of CTLA-4 compared to a wildtype or unmodified CD80 polypeptide, such as comprising the sequence set forth in SEQ ID NO: 28, 152, or 372. In some embodiments, the variant CD80 polypeptide has one or more amino acid modifications (e.g., substitutions) corresponding to position(s) 36, 40, 52, 70, 88, 89, 90, 91, 92, 93, 107, 118120, 130, 144, or 169 of SEQ ID NO: 28. In some embodiments, the variant CD80 polypeptide has one or more amino acid substitutions selected from the group consisting of K36G, L40M, E52G, L70Q, E88D, K89R, D90K, A91G, F92Y, K93R, D107N, I118V, T120S, T130A, N144D, and K169E. In some embodiments, the variant CD80 polypeptide has one or more amino acid substitutions selected from the group consisting of K36G, L40M, E52G, L70Q, E88D, K89R, D90K, A91G, F92Y, K93R, D107N, I118V, T120S, T130A N144D, and K169E, and conservative amino acid substitutions thereof. In some embodiments, the one or more amino acid substitution is K36G, K36G/L40M, E52G/L70Q/A91G/T120S/T130A, E52G/L70Q/A91G/D107N/I118V/T120S/T130A/K169E, L70Q/A91G, L70Q/A91G/N144D, L70Q/A91G/T120S/T130A, L70Q/A91G/I118V/T120S/T130A/K169E, E88D/K89R/D90K/A91G/F92Y/K93R, or K89R/D90K/A91G/F92Y/K93R. In some embodiments, the variant CD80 polypeptide exhibits increased affinity for the ectodomain of CD28 and the ectodomain of CTLA-4 compared to a wildtype or unmodified CD80 polypeptide, such as comprising the sequence set forth in SEQ ID NO: 28, 152, or 372.

In some embodiments, the variant CD80 polypeptide has one or more amino acid modifications (e.g., substitutions) corresponding to position(s) 29, 31, 36, 40, 41, 67, 70, 87, 88, 89, 90, 91, 92, 93, 109, 118, 120, 122, 130, or 178 of SEQ ID NO: 28. In some embodiments, the variant CD80 polypeptide has one or more amino acid substitutions selected from the group consisting of R29H, Y31H, K36G, L40M, T41G, I67T, L70Q, Y87N, E88D, E88G, K89E, K89R, D90N, D90K, A91G, F92Y, K93R, P109S, I118V, T120S. In some embodiments, the variant CD80 polypeptide has one or more amino acid substitutions selected from the group consisting of R29H, Y31H, K36G, L40M, T41G, I67T, L70Q, Y87N, E88D, E88G, K89E, K89R, D90N, D90K, A91G, F92Y, K93R, P109S, I118V, T120S, and conservative amino acid substitutions thereof. In some embodiments, the one or more amino acid substitutions is R29H/Y31H/T41G/Y87N/E88G/K89E/D90N/A91G/P109S, K36G, K36G/L40M, I67T/L70Q/A91G/T120S, I67T/L70Q/A91G/I118V/T120S, E88D/K89R/D90K/A91G/F92Y/K93R, or K89R/D90K/A91G/F92Y/K93R. In some embodiments, the variant CD80 polypeptide exhibits increased affinity for the ectodomain of PD-L1 and the ectodomain of CTLA-4 compared to wild-type or an unmodified CD80 polypeptide, such as comprising the sequence set forth in SEQ ID NO: 28, 152, or 372.

In some embodiments, the variant CD80 polypeptide has one or more amino acid modifications (e.g., substitutions) corresponding to position(s) 36, 40, 88 89, 90, 91, 92, or 93 of SEQ ID NO: 28. In some embodiments, the variant CD80 polypeptide has one or more amino acid substitutions selected from the group consisting of K36G, L40M, E88D, K89R, D90K, A91G, F92Y, and K93R. In some embodiments, the variant CD80 polypeptide has one or more amino acid substitutions selected from the group consisting of K36G, L40M, E88D, K89R, D90K, A91G, F92Y, K93R, and conservative amino acid substitutions thereof. In some embodiments, the one or more amino acid substitutions is K36G, K36G/L40M, E88D/K89R/D90K/A91G/F92Y/K93R, or K89R/D90K/A91G/F92Y/K93R. In some embodiments, the variant CD80 polypeptide exhibits increased affinity for the ectodomain of CD28, the ectodomain of PD-L1 and the ectodomain of CTLA-4 compared to wild-type or an unmodified CD80 polypeptide, such as comprising the sequence set forth in SEQ ID NO: 28, 152, or 372.

In some embodiments, the variant CD80 polypeptide has one or more amino acid modifications (e.g., substitutions) corresponding to position(s) 12, 18, 29, 31, 33, 36, 38, 40, 41, 42, 43, 47, 48, 63, 59, 64, 67, 68, 70, 81, 85, 87, 88, 89, 90, 91, 92, 93, 94, 97, 104, 109, 114, 115, 117, 118, 120, 122, 126, 127, 130, 133, 140, 144, 148, 149, 168, 169, 177, 183, 188 or 193 of SEQ ID NO: 28. In some embodiments, the variant CD80 polypeptide has one or more amino acid substitutions selected from the group consisting of A12G, A12T, H18L, S21P, V22A, T28A, R29D, R29H, Y31H, Y31L, Q33H, K36G, M38I, L0M, T41A, T41G, M42T, M43R, M43V, M47T, N48I, F59L, N63S, N64S, I67T, V68A, V68M, L70Q, E77K, E81A, E81V, L85R, Y87N, E88D, E88G, K89E, K89N, D90K, D90N, A91G, A91T, F92P, F92Y, K93R, K93V, R94F, R94L, L97R, S103L, S103P, V104L, P109H, P109S, D115G, E117V, 118T, S114T, 118V, T120S, N122S, I126L, I127T, T130A, G133D, S140T, N144S, L148S, N149S, S168G, K169I, K169S, N177S, L183H, H188Q, R190S and Q193L. In some embodiments, the variant CD80 polypeptide has one or more amino acid substitutions selected from the group consisting of R29D, R29H, Y31H, Y31L, Q33H, K36G, M38I, T41A, T41G, M42T, M43R, M47T, N63S, 167T, L70Q, E81A, E81V, L85R, Y87N, E88G, K89E, K89N, D90N, A91G, A91T, F92P, K93V, R94L, P109S, S114T, I118V, I118T, T120S, I127T, T130A, N144S, L148S, and N149S, and conservative amino acid substitutions thereof. In some embodiments, the one or more amino acid substitutions is N63S/L70Q/A91G/T120S/T130A, N63S/L70Q/A91G/S114T/I118V/T120S/T130A, L70Q/Y87N/A91G/T120S/I127T/T130A. In some embodiments, the one or more amino acid substitutions is A12T/H18L/M43V/F59L/E77K/P109S/I118T, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144S/N149S, R29D/Y31L/Q33H/K36G/M38I/T41A/M42T/M43R/M47T/E81V/L85R/K89N/A91T/F92P/K93V/R94L/L148S/N149S, R29D/Y31L/Q33H/K36G/M38I/T41A/M43R/M47T/E81V/L85R/K89N/A91T/F92P/K93V/R94L/N149S, R29H/Y31H/T41G/Y87N/E88G/K89E/D90N/A91G/P109S, K36G, K36G/L40M, I67T/L70Q/A91G/T120S, I67T/L70Q/A91G/I118V/T120S, E88D/K89R/D90K/A91G/F92Y/K93R, K89R/D90K/A91G/F92Y/K93R, A91G, H18L/R29D/Y31L/Q33H/K36G/M38I/T41A/M43R/M47T/E81V/L85R/K89N/A91T/F92P/K93V/R94L/I118V/T120S/I127T/T130A/H188D, R29D/Y31L/Q33H/K36G/M38I/T41A/M43R/M47T/V68M/E81V/L85R/K89N/A91T/F92P/K93V/R94L/T130A/N149S/R190S, R29D/Y31L/Q33H/K36G/M38I/T41A/M43R/M47T/E81V/L85R/K89N/A91T/F92P/K93V/R94F/E117V/I118T/N149S/S168G/H188Q, V22A/R29D/Y31L/Q33H/K36G/M38I/T41A/M43R/M47T/V68M/E81V/L85R/K89N/A91T/F92P/K93V/R94L/T130A, R29D/Y31L/Q33H/K36G/M38I/T41A/M43R/M47T/N64S/E81V/L85R/K89N/A91T/F92P/K93V/R94F/I118T/T130A/N149S/K169I, V22A/R29D/Y31L/Q33H/K36G/M38I/T41A/M43R/M47T/V68M/E81V/L85R/K89N/A91T/F92P/K93V/R94L/D15G/I118T/T130A/G133D/N149S, T28A/R29D/Y31L/Q33H/K36G/M38I/T41A/M43R/M47T/E81V/L85R/K89N/A91T/F92P/K93V/R94L/V104L/T130A/N149S, H18L/R29D/Y31L/Q33H/K36G/M38I/T41A/M43R/M47T/E81V/L85R/K89N/A91T/F92P/K93V/R94L/L97R/N149S/H188Q, K89E/T130A, K89E/K93E/T130A, S21P/R29D/Y31L/Q33H/K36G/M38I/T41A/M43R/M47T/N48I/V68A/E81V/L85R/K89N/A91T/F92P/K93V/R94L/S21P/N48I/V68A/P109H/I126L/K169I, H18L/R29D/Y31L/Q33H/K36G/M38I/T41A/M43R/M47T/V68M/E81V/L85R/K89N/A91T/F92P/K93V/R94L/T130A, H18L/R29D/Y31L/Q33H/K36G/M38I/T41A/M43R/M47T/E81V/L85R/K89N/A91T/F92P/K93V/R94L/T130A/N149S, A12G/R29D/Y31L/Q33H/K36G/M38I/T41A/M43R/M47T/V68A/E81V/L85R/K89N/A91T/F92P/K93V/R94L/L97R/T130A/L183H, R29D/Y31L/Q33H/K36G/M38I/T41A/M43R/M47T/E81V/L85R/K89N/A91T/F92P/K93V/R94L/I118T/T130A/S140T/N149S/K169S, R29D/Y31L/Q33H/K36G/M38I/T41A/M43R/M47T/E81V/L85R/K89N/A91T/F92P/K93V/R94L/I118T/T130A/N149S/K169I/Q193L, V22A/R29D/Y31L/Q33H/K36G/M38I/T41A/M43R/M47T/E81V/L85R/K89N/A91T/F92P/K93V/R94L/I118T/T130A/N149S, R29D/Y31L/Q33H/K36G/M38I/T41A/M43R/M47T/E81V/L85R/K89N/A91T/F92P/K93V/R94L/I118T/T130A/N149S, R29D/Y31L/Q33H/K36G/M38I/T41A/M43R/M47T/E81V/L85R/K89N/A91T/F92P/K93V/R94L/I118T/T130A/N149S/K169I, or R29D/Y31L/Q33H/K36G/M38I/T41A/M43R/M47T/E81V/L85R/K89N/A91T/F92P/K93V/R94F/T130A/N149S/K169I. In some embodiments, the variant CD80 polypeptide exhibits increased affinity for the ectodomain of CD28 or the ectodomain of PD-L1, and decreased affinity for the ectodomain of CTLA-4, compared to wild-type or unmodified CD80 polypeptide, such as comprising the sequence set forth in SEQ ID NO: 28, 152, or 372.

In some embodiments, the variant CD80 polypeptide has one or more amino acid modifications (e.g., substitutions) corresponding to position(s) 63, 70, 81, 87, 91, 114, 118, 120, 127, or 130 of SEQ ID NO: 28. In some embodiments, the variant CD80 polypeptide has one or more amino acid substitutions selected from the group consisting of N63S, L70Q, E81A, Y87N, A91G, S114T, I118V, T120S, I127T, and T130A. In some embodiments, the variant CD80 polypeptide has one or more amino acid substitutions selected from the group consisting of N63S, L70Q, E81A, Y87N, A91G, S114T, I118V, T120S, I127T, and T130A, and conservative amino acid substitutions thereof. In some embodiments, the one or more amino acid substitution is R29D/Y31L/Q33H/K36G/M38I/T41A/M42T/M43R/M47T/E81V/L85R/K89N/A91T/F92P/K93V/R94L/L148S/N149S, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144S/N149S, R29D/Y31L/Q33H/K36G/M38I/T41A/M43R/M47T/E81V/L85R/K89N/A91T/F92P/K93V/R94L/N149S, R29H/Y31H/T41G/Y87N/E88G/K89E/D90N/A91G/P109S, N63S/L70Q/A91G/T120S/T130A, N63S/L70Q/A91G/S114T/I118V/T120S/T130A, I67T/L70Q/A91G/T120S, I67T/L70Q/A91G/I118V/T120S, or L70Q/Y87N/A91G/T120S/I127T/T130A. In some embodiments, the variant CD80 polypeptide exhibits increased affinity for the ectodomain of CD28, and decreased affinity for the ectodomain of CTLA-4, compared to wild-type or unmodified CD80 polypeptide, such as comprising the sequence set forth in SEQ ID NO: 28, 152, or 372.

In some embodiments, the variant CD80 polypeptide has one or more amino acid modifications (e.g., substitutions) corresponding to position(s) 12, 18, 29, 31, 33, 36, 38, 40, 41, 42, 43, 47, 48, 59, 64, 67, 68, 70, 77, 81, 85, 87, 88, 89, 90, 91, 92, 93, 94, 97, 104, 109, 115, 117, 118, 120, 122, 126, 130, 133, 140, 144, 148, 149, 168, 169, 177, 183, 188 or 193 of SEQ ID NO: 28. In some embodiments, the variant CD80 polypeptide has one or more amino acid substitutions selected from the group consisting of A12G, A12T, H18L, S21P, V22A, T28A, R29D, R29H, Y31H, Y31L, Q33H, K36G, M38I, L40M, T41A, T41G, M42T, M43R, M47T, M43V, N48I, F59L, N64S, I67T, V68A, V68M, L70Q, E77K, E81V, L85R, Y87N, E88D, E88G, K89E, K89N, K89R, D90K, D90N, A91G, A91T, F92P, F92Y, K93V, R94F, R94L, L97R, S103L, S103P, V104L, P109H, P109S, D115G, E117V, I118T, I118V, T120S, N122S, I126L, T130A, G133D, S140T, N144S, L148S, N149S, S168G, K169I, K169S, N177S, L183H, H188Q, R190S and Q193L. In some embodiments, the variant CD80 polypeptide has one or more amino acid substitutions selected from the group consisting of R29D, R29H, Y31H, Y31L, Q33H, K36G, M38I, T41A, T41G, M42T, M43R, M47T, I67T, L70Q, E81V, L85R, Y87N, E88G, K89E, K89N, D90N, A91G, A91T, F92P, K93V, R94L, P109S, I118T, I118V, T120S, N144S, L148S, and N149S, and conservative amino acid substitutions thereof. In some embodiments, the one or more amino acid substitution is R29D/Y31L/Q33H/K36G/M38I/T41A/M42T/M43R/M47T/E81V/L85R/K89N/A91T/F92P/K93V/R94L/L148S/N149S, R29D/Y31L/Q33H/

K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144S/N149S, R29D/Y31L/Q33H/K36G/M38I/T41A/M43R/M47T/E81V/L85R/K89N/A91T/F92P/K93V/R94L/N149S, R29H/Y31H/T41G/Y87N/E88G/K89E/D90N/A91G/P109S, I67T/L70Q/A91G/I118V/T120S, or I67T/L70Q/A91G/T120S. In some embodiments, the one or more amino acid substitutions is A12T/H18L/M43V/F59L/E77K/P109S/I118T, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144S/N149S, R29D/Y31L/Q33H/K36G/M38I/T41A/M42T/M43R/M47T/E81V/L85R/K89N/A91T/F92P/K93V/R94L/L148S/N149S, R29D/Y31L/Q33H/K36G/M38I/T41A/M43R/M47T/E81V/L85R/K89N/A91T/F92P/K93V/R94L/N149S, R29H/Y31H/T41G/Y87N/E88G/K89E/D90N/A91G/P109S, K36G, K36G/L40M, I67T/L70Q/A91G/T120S, I67T/L70Q/A91G/I118V/T120S, E88D/K89R/D90K/A91G/F92Y/K93R, K89R/D90K/A91G/F92Y/K93R, A91G, H18L/R29D/Y31L/Q33H/K36G/M38I/T41A/M43R/M47T/E81V/L85R/K89N/A91T/F92P/K93V/R94L/I118V/T120S/I127T/T130A/H188D, R29D/Y31L/Q33H/K36G/M38I/T41A/M43R/M47T/V68M/E81V/L85R/K89N/A91T/F92P/K93V/R94L/T130A/N149S/R190S, R29D/Y31L/Q33H/K36G/M38I/T41A/M43R/M47T/E81V/L85R/K89N/A91T/F92P/K93V/R94F/E117V/I118T/N149S/S168G/H188Q, V22A/R29D/Y31L/Q33H/K36G/M38I/T41A/M43R/M47T/V68M/E81V/L85R/K89N/A91T/F92P/K93V/R94L/T130A, R29D/Y31L/Q33H/K36G/M38I/T41A/M43R/M47T/N64S/E81V/L85R/K89N/A91T/F92P/K93V/R94F/I118T/T130A/N149S/K169I, V22A/R29D/Y31L/Q33H/K36G/M38I/T41A/M43R/M47T/V68M/E81V/L85R/K89N/A91T/F92P/K93V/R94L/D115G/I118T/T130A/G133D/N149S, T28A/R29D/Y31L/Q33H/K36G/M38I/T41A/M43R/M47T/E81V/L85R/K89N/A91T/F92P/K93V/R94L/V104L/T130A/N149S, H18L/R29D/Y31L/Q33H/K36G/M38I/T41A/M43R/M47T/E81V/L85R/K89N/A91T/F92P/K93V/R94L/L97R/N149S/H188Q, K89E/T130A, K89E/K93E/T130A, S21P/R29D/Y31L/Q33H/K36G/M38I/T41A/M43R/M47T/N48I/V68A/E81V/L85R/K89N/A91T/F92P/K93V/R94L/S21P/N48I/V68A/P109H/I126L/K169I, H18L/R29D/Y31L/Q33H/K36G/M38I/T41A/M43R/M47T/V68M/E81V/L85R/K89N/A91T/F92P/K93V/R94L/T130A, H18L/R29D/Y31L/Q33H/K36G/M38I/T41A/M43R/M47T/E81V/L85R/K89N/A91T/F92P/K93V/R94L/T130A/N149S, A12G/R29D/Y31L/Q33H/K36G/M38I/T41A/M43R/M47T/V68A/E81V/L85R/K89N/A91T/F92P/K93V/R94L/L97R/T130A/L183H, R29D/Y31L/Q33H/K36G/M38I/T41A/M43R/M47T/E81V/L85R/K89N/A91T/F92P/K93V/R94L/I118T/T130A/S140T/N149S/K169S, R29D/Y31L/Q33H/K36G/M38I/T41A/M43R/M47T/E81V/L85R/K89N/A91T/F92P/K93V/R94L/I118T/T130A/N149S/K169I/Q193L, V22A/R29D/Y31L/Q33H/K36G/M38I/T41A/M43R/M47T/E81V/L85R/K89N/A91T/F92P/K93V/R94L/I118T/T130A/N149S, R29D/Y31L/Q33H/K36G/M38I/T41A/M43R/M47T/E81V/L85R/K89N/A91T/F92P/K93V/R94L/I118T/T130A/N149S, R29D/Y31L/Q33H/K36G/M38I/T41A/M43R/M47T/E81V/L85R/K89N/A91T/F92P/K93V/R94L/I118T/T130A/N149S/K169I, or R29D/Y31L/Q33H/K36G/M38I/T41A/M43R/M47T/E81V/L85R/K89N/A91T/F92P/K93V/R94F/T130A/N149S/K169I. In some embodiments, the variant CD80 polypeptide exhibits increased affinity for the ectodomain of PD-L1, and decreased affinity for the ectodomain of CTLA-4, compared to wild-type or unmodified CD80 polypeptide, such as comprising the sequence set forth in SEQ ID NO: 28, 152, or 372.

In some embodiments, the variant CD80 polypeptide has one or more amino acid modifications (e.g., substitutions) corresponding to position(s) 70, 81, 87, 91, or 120 of SEQ ID NO: 28. In some embodiments, the variant CD80 polypeptide has one or more amino acid substitutions selected from the group consisting of L70Q, Y87N, A91G, and T120S. In some embodiments, the variant CD80 polypeptide has one or more amino acid substitutions selected from the group consisting of L70Q, Y87N, A91G, and T120S, and conservative amino acid substitutions thereof. In some embodiments, the variant CD80 polypeptide exhibits increased affinity for the ectodomain of CD28 and the ectodomain of PD-L1, and decreased affinity for the ectodomain of CTLA-4, compared to wild-type or unmodified CD80 polypeptide, such as comprising the sequence set forth in SEQ ID NO: 28, 152, or 372.

III. FORMAT OF VARIANT POLYPEPTIDES

The immunomodulatory polypeptide comprising a variant CD80 provided herein in which is contained a vIgD can be formatted in a variety of ways, including as a soluble protein, fusion or conjugate, membrane bound protein, secreted protein or for delivery in an infectious agent. In some embodiments, the particular format can be chosen for the desired therapeutic application. In some cases, an immunomodulatory polypeptide comprising a variant CD80 polypeptide is provided in a format to antagonize or block activity of its cognate binding partner, e.g. CD28, PD-L1 and/or CTLA-4. In some embodiments, antagonism of CTLA-4 may be useful to promote immunity in oncology. In some embodiments, antagonism of CD28 may be useful for treating inflammation or autoimmunity. In some cases, an immunomodulatory polypeptide comprising a variant CD80 polypeptide is provided in a format to agonize or stimulate activity of its cognate binding partner, e.g. CD28, PD-L1 and/or CTLA-4. In some embodiments, agonism of CTLA-4 may be useful for treating inflammation or autoimmunity. In some embodiments, agonism of CD28 may be useful for treating oncology. A skilled artisan can readily determine the activity of a particular format, such as for antagonizing or agonizing one or more specific cognate binding partner. Exemplary methods for assessing such activities are provided herein, including in the examples.

In some aspects, provided are immunomodulatory proteins comprising a vIgD of CD80 in which such proteins are soluble, e.g. fused to an Fc chain. In some aspects, one or more additional IgSF domain, such as one or more additional vIgD, may be linked to a vIgD of CD80 as provided herein (hereinafter called a "stack" or "stacked" immunomodulatory protein). In some embodiments, the modular format of the provided immunomodulatory proteins provides flexibility for engineering or generating immunomodulatory proteins for modulating activity of multiple counterstructures (multiple cognate binding partners). In some embodiments, such "stack" molecules can be provided in a soluble format or, in some cases, may be provided as membrane bound or secreted proteins. In some embodiments, a variant CD80 immunomodulatory protein is provided as a conjugate in which is contained a vIgD of CD80 linked, directly or indirectly, to a targeting agent or moiety, e.g. to an antibody or other binding molecules that specifically binds to a ligand, e.g. an antigen, for example, for targeting or localizing the vIgD to a specific environment or cell, such as when administered to a subject. In some embodiments, the targeting agent, e.g. antibody or other binding molecule, binds to a tumor antigen, thereby localizing the variant CD80 containing the vIgD to the tumor microenvironment, for example, to modulate activity of tumor infiltrating lymphocytes (TILs) specific to the tumor microenvironment.

In some embodiments, provided immunomodulatory proteins are expressed in cells and provided as part of an engineered cellular therapy (ECT). In some embodiments, the variant CD80 polypeptide is expressed in a cell, such as an immune cell (e.g. T cell or antigen presenting cell), in membrane-bound form, thereby providing a transmembrane immunomodulatory protein (hereinafter also called a "TIP"). In some embodiments, depending on the cognate binding partner recognized by the TIP, engineered cells expressing a TIP can agonize a cognate binding partner by providing a costimulatory signal, either positive to negative, to other engineered cells and/or to endogenous T cells. In some aspects, the variant CD80 polypeptide is expressed in a cell, such as an immune cell (e.g. T cell or antigen presenting cell), in secretable form to thereby produce a secreted or soluble form of the variant CD80 polypeptide (hereinafter also called a "SIP"), such as when the cells are administered to a subject. In some aspects, a SIP can antagonize a cognate binding partner in the environment (e.g. tumor microenvironment) in which it is secreted. In some embodiments, a variant CD80 polypeptide is expressed in an infectious agent (e.g. viral or bacterial agent) which, upon administration to a subject, is able to infect a cell in vivo, such as an immune cell (e.g. T cell or antigen presenting cell), for delivery or expression of the variant polypeptide as a TIP or a SIP in the cell.

In some embodiments, a soluble immunomodulatory polypeptide, such as a variant CD80 containing a vIgD, can be encapsulated within a liposome which itself can be conjugated to any one of or any combination of the provided conjugates (e.g., a targeting moiety). In some embodiments, the soluble or membrane bound immunomodulatory polypeptides of the invention are deglycosylated. In more specific embodiments, the variant CD80 sequence is deglycosylated. In even more specific embodiments, the IgV and/or IgC (e.g. IgC2) domain or domains of the variant CD80 is deglycosylated.

Figure 1B:
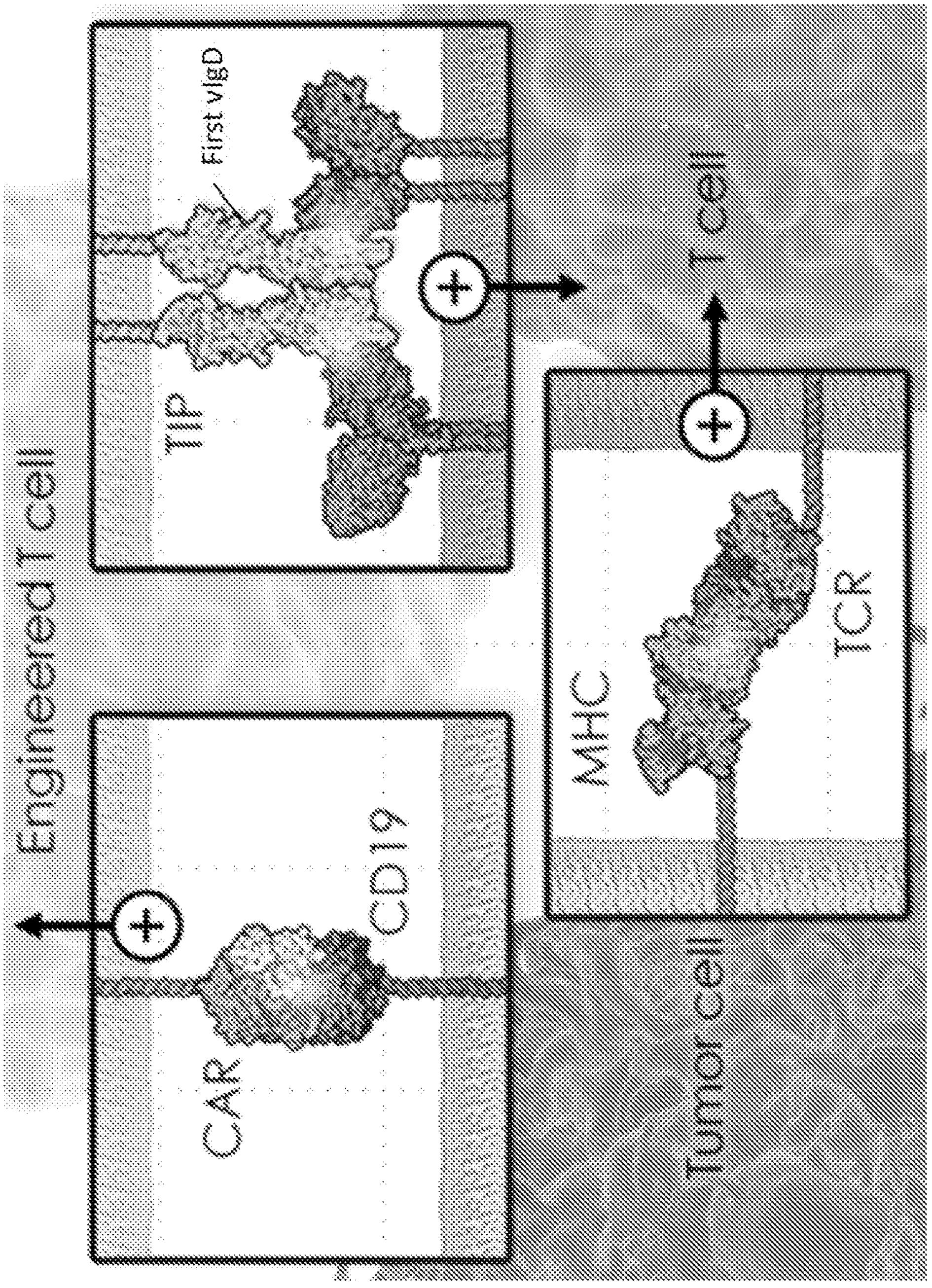
Figure 1C:
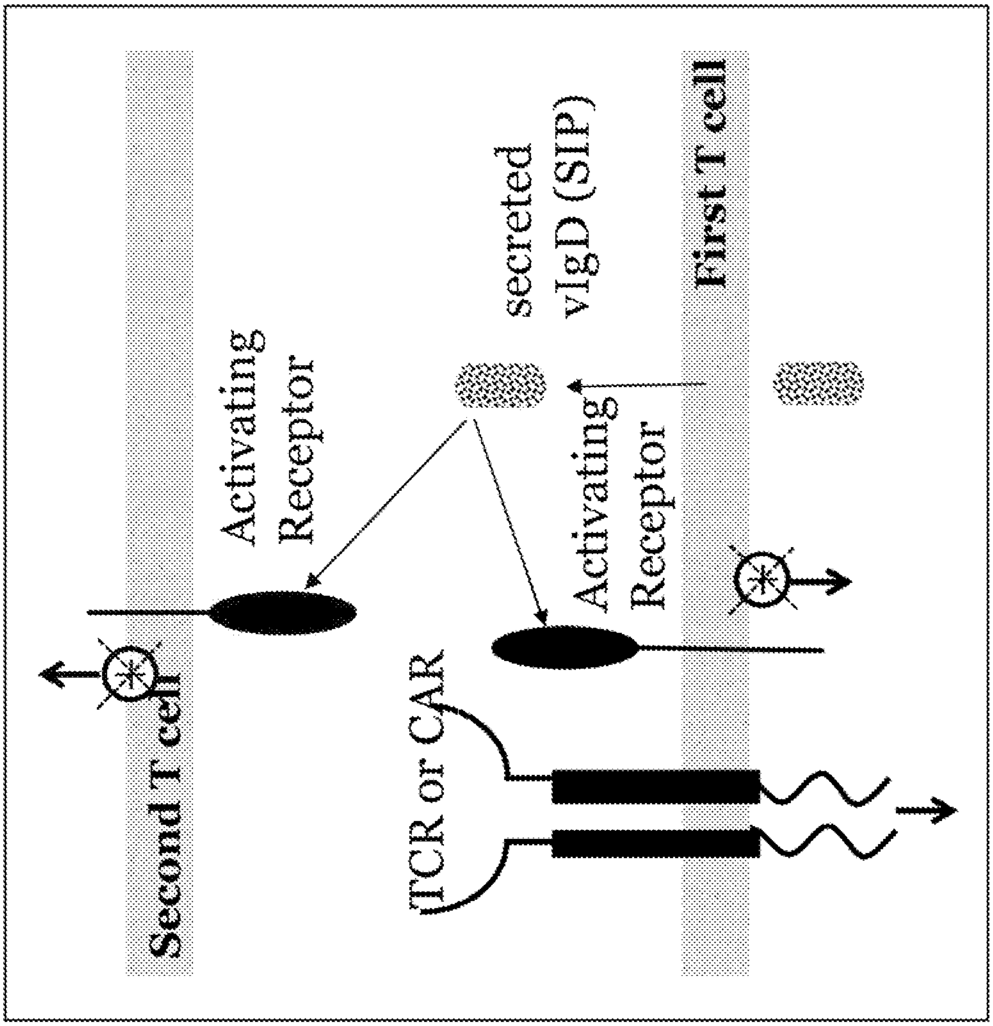
Figure 2:
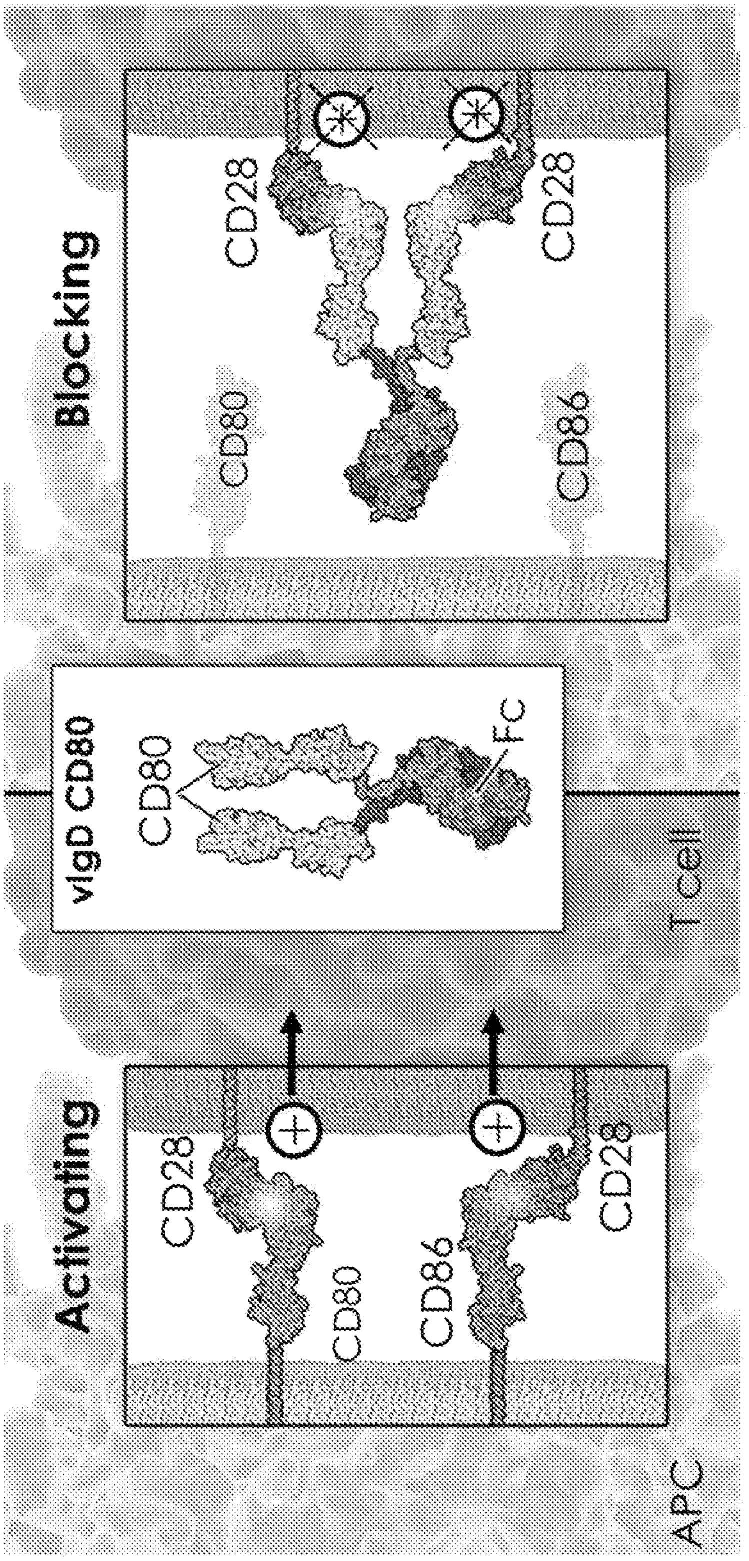
FIG. 2 depicts an exemplary schematic of the activity of a variant IgSF domain (vIgD) fused to an Fc (vIgD-Fc) in which the vIgD is a variant of an IgSF domain of CD80. As shown, a soluble vIgD of CD80 interacts with its cognate binding partners to block interactions of CD28, respectively, thereby blocking costimulation by the CD28 costimulatory receptors.
Figure 3:
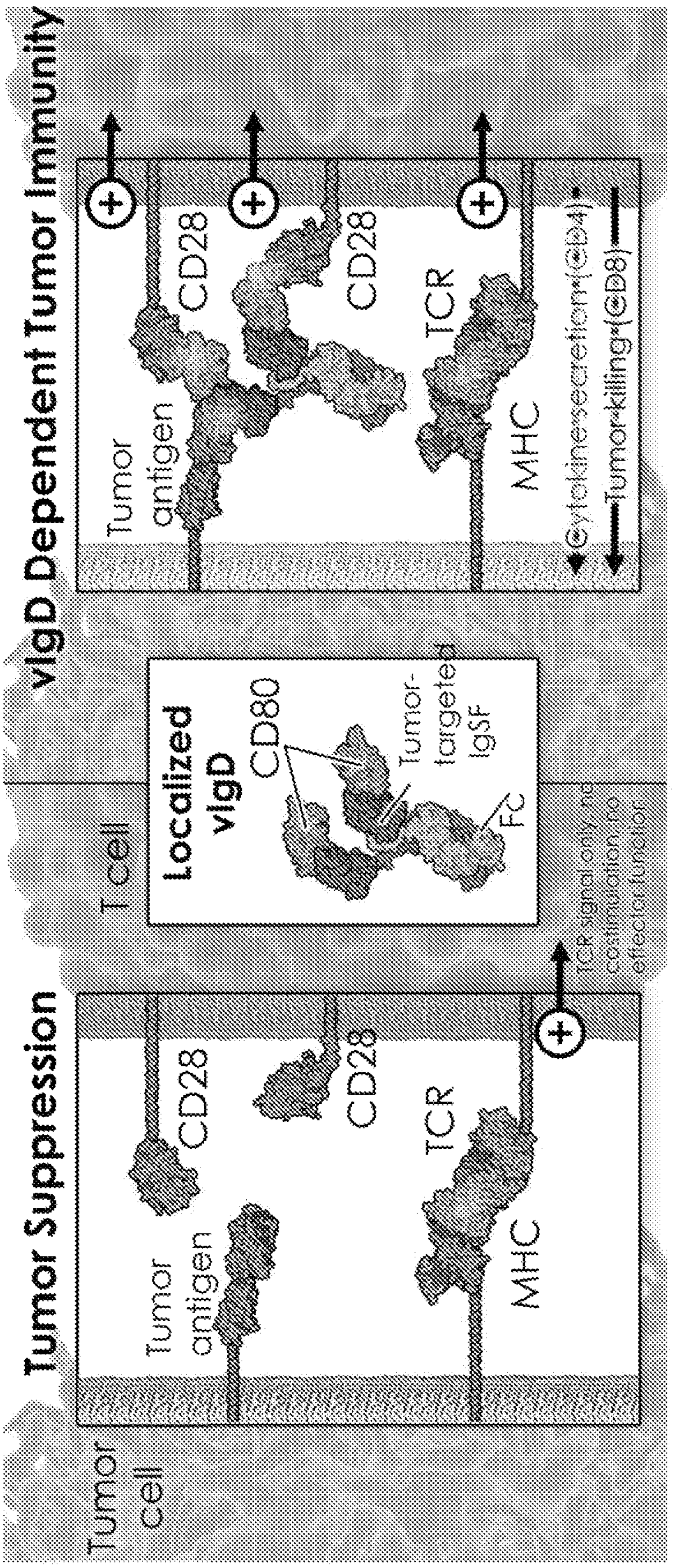
FIG. 3 depicts an exemplary schematic of a stack molecule for localizing the variant IgSF domain (vIgD) to a tumor cell. In this format, the stack molecule contains a first variant IgSF domain (first vIgD) and a second IgSF domain (e.g. a second vIgD) in which the second IgSF domain (e.g a second vIgD) is a tumor-targeted IgSF domain that binds to a tumor antigen. An exemplary tumor-targeted IgSF domain is an IgSF domain of NkP30, which binds to the tumor antigen B7-H6. In this depiction, the vIgD is a variant of an IgSF domain of CD80. As shown, binding of tumor-targeted IgSF domain to the surface of the tumor cell localizes the first vIgD on the tumor cell surface where it can interact with one or more of its cognate binding partner (e.g. CD28) expressed on the surface of an adjacent immune cell (e.g. T cell) to stimulate the costimulatory receptor.

Non-limiting examples of provided formats are described in FIGS. 1A-1C and further described below.

A. Soluble Protein

In some embodiments, the immunomodulatory protein containing a variant CD80 polypeptide is a soluble protein. Those of skill will appreciate that cell surface proteins typically have an intracellular, transmembrane, and extracellular domain (ECD) and that a soluble form of such proteins can be made using the extracellular domain or an immunologically active subsequence thereof. Thus, in some embodiments, the immunomodulatory protein containing a variant CD80 polypeptide lacks a transmembrane domain or a portion of the transmembrane domain. In some embodiments, the immunomodulatory protein containing a variant CD80 lacks the intracellular (cytoplasmic) domain or a portion of the intracellular domain. In some embodiments, the immunomodulatory protein containing the variant CD80 polypeptide only contains the vIgD portion containing the ECD domain or a portion thereof containing an IgV domain and/or IgC (e.g. IgC2) domain or domains or specific binding fragments thereof containing the amino acid modification(s).

In some embodiments, an immunomodulatory polypeptide comprising a variant CD80 can include one or more variant CD80 polypeptides of the invention. In some embodiments a polypeptide of the invention will comprise exactly 1, 2, 3, 4, 5 variant CD80 sequences. In some embodiments, at least two of the variant CD80 sequences are identical variant CD80 sequences.

In some embodiments, the provided immunomodulatory polypeptide comprises two or more vIgD sequences of CD80. Multiple variant CD80 polypeptides within the polypeptide chain can be identical (i.e., the same species) to each other or be non-identical (i.e., different species) variant CD80 sequences. In addition to single polypeptide chain embodiments, in some embodiments two, three, four, or more of the polypeptides of the invention can be covalently or non-covalently attached to each other. Thus, monomeric, dimeric, and higher order (e.g., 3, 4, 5, or more) multimeric proteins are provided herein. For example, in some embodiments exactly two polypeptides of the invention can be covalently or non-covalently attached to each other to form a dimer. In some embodiments, attachment is made via interchain cysteine disulfide bonds. Compositions comprising two or more polypeptides of the invention can be of an identical species or substantially identical species of polypeptide (e.g, a homodimer) or of non-identical species of polypeptides (e.g., a heterodimer). A composition having a plurality of linked polypeptides of the invention can, as noted above, have one or more identical or non-identical variant CD80 polypeptides of the invention in each polypeptide chain.

In some embodiments, the immunomodulatory protein comprises a variant CD80 polypeptide attached to an immunoglobulin Fc (yielding an "immunomodulatory Fc fusion," such as a "variant CD80-Fc fusion," also termed a CD80 vIgD-Fc fusion). In some embodiments, the attachment of the variant CD80 polypeptide is at the N-terminus of the Fc. In some embodiments, the attachment of the variant CD80 polypeptide is at the C-terminus of the Fc. In some embodiments, two or more CD80 variant polypeptides (the same or different) are independently attached at the N-terminus and at the C-terminus.

In some embodiments, the Fc is murine or human Fc. In some embodiments, the Fc is a mammalian or human IgG1, lgG2, lgG3, or lgG4 Fc regions. In some embodiments, the Fc is derived from IgG1, such as human IgG1. In some embodiments, the Fc comprises the amino acid sequence set forth in SEQ ID NO: 226 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 226.

In some embodiments, the Fc region contains one more modifications to alter (e.g. reduce) one or more of its normal functions. In general, the Fc region is responsible for effector functions, such as complement-dependent cytotoxicity (CDC) and antibody-dependent cell cytotoxicity (ADCC), in addition to the antigen-binding capacity, which is the main function of immunoglobulins. Additionally, the FcRn sequence present in the Fc region plays the role of regulating the IgG level in serum by increasing the in vivo half-life by binding to an in vivo FcRn receptor. In some embodiments, such functions can be reduced or altered in an Fc for use with the provided Fc fusion proteins.

In some embodiments, one or more amino acid modifications may be introduced into the Fc region of a CD80-Fc variant fusion provided herein, thereby generating an Fc region variant. In some embodiments, the Fc region variant has decreased effector function. There are many examples of changes or mutations to Fc sequences that can alter effector function. For example, WO 00/42072, WO2006019447, WO2012125850, WO2015/107026, US2016/0017041 and Shields et al. *J Biol. Chem.* 9(2): 6591-6604 (2001) describe exemplary Fc variants with improved or diminished binding to FcRs. The contents of those publications are specifically incorporated herein by reference.

In some embodiments, the provided variant CD80-Fc fusions comprise an Fc region that exhibits reduced effector functions, which makes it a desirable candidate for applications in which the half-life of the CD80-Fc variant fusion in vivo is important yet certain effector functions (such as CDC and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the CD80-Fc variant fusion lacks FcγR binding (hence likely lacking ADCC activity), but retains FcRn binding ability. The primary cells for mediating ADCC, NK cells, express FcγRIII only, whereas monocytes express FcγRI, FcγRII and FcγRIII. FcR expression on hematopoietic cells is summarized in Table 3 on page 464 of Ravetch and Kinet, *Annu. Rev. Immunol.* 9:457-492 (1991). Non-limiting examples of in vitro assays to assess ADCC activity of a molecule of interest is described in U.S. Pat. No. 5,500,362 (see, e.g. Hellstrom, I. et al. *Proc. Nat'l Acad. Sci. USA* 83:7059-7063 (1986)) and Hellstrom, I et al., *Proc. Nat'l Acad. Sci. USA* 82:1499-1502 (1985); U.S. Pat. No. 5,821,337 (see Bruggemann, M. et al., *J. Exp. Med.* 166:1351-1361 (1987)). Alternatively, non-radioactive assay methods may be employed (see, for example, ACTI™ non-radioactive cytotoxicity assay for flow cytometry (CellTechnology, Inc. Mountain View, Calif.; and CytoTox 96™ non-radioactive cytotoxicity assay (Promega, Madison, Wis.). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model such as that disclosed in Clynes et al. *Proc. Nat'l Acad. Sci. USA* 95:652-656 (1998). C1q binding assays may also be carried out to confirm that the CD80-Fc variant fusion is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., *J. Immunol. Methods* 202:163 (1996); Cragg, M. S. et al., *Blood* 101: 1045-1052 (2003); and Cragg, M. S. and M. J. Glennie, *Blood* 103:2738-2743 (2004)). FcRn binding and in vivo clearance/half life determinations can also be performed using methods known in the art (see, e.g., Petkova, S. B. et al., *Int'l. Immunol.* 18(12):1759-1769 (2006)).

CD80-Fc variant fusions with reduced effector function include those with substitution of one or more of Fc region residues 238, 265, 269, 270, 297, 327 and 329 by EU numbering (U.S. Pat. No. 6,737,056). Such Fc mutants include Fc mutants with substitutions at two or more of amino acid positions 265, 269, 270, 297 and 327 by EU numbering, including the so-called "DANA" Fc mutant with substitution of residues 265 and 297 to alanine (U.S. Pat. No. 7,332,581).

In some embodiments, the Fc region of CD80-Fv variant fusions has an Fc region in which any one or more of amino acids at positions 234, 235, 236, 237, 238, 239, 270, 297, 298, 325, and 329 (indicated by EU numbering) are substituted with different amino acids compared to the native Fc region. Such alterations of Fc region are not limited to the above-described alterations, and include, for example, alterations such as deglycosylated chains (N297A and N297Q), IgG1-N297G, IgG1-L234A/L235A, IgG1-L234A/L235E/G237A, IgG1-A325A/A330S/P331S, IgG1-C226S/C229S, IgG1-C226S/C229S/E233P/L234V/L235A, IgG1-E233P/L234V/L235A/G236del/S267K, IgG1-L234F/L235E/P331S, IgG1-S267E/L328F, IgG2-V234A/G237A, IgG2-H268Q/V309L/A330S/A331S, IgG4-L235A/G237A/E318A, and IgG4-L236E described in Current Opinion in Biotechnology (2009) 20 (6), 685-691; alterations such as G236R/L328R, L235G/G236R, N325A/L328R, and N325LL328R described in WO 2008/092117; amino acid insertions at positions 233, 234, 235, and 237 (indicated by EU numbering); and alterations at the sites described in WO 2000/042072.

Certain Fc variants with improved or diminished binding to FcRs are described. (See, e.g., U.S. Pat. No. 6,737,056; WO 2004/056312, WO2006019447 and Shields et al., *J. Biol. Chem.* 9(2): 6591-6604 (2001).)

In some embodiments, there is provided a CD80-Fc variant fusion comprising a variant Fc region comprising one or more amino acid substitutions which increase half-life and/or improve binding to the neonatal Fc receptor (FcRn). Antibodies with increased half-lives and improved binding to FcRn are described in US2005/0014934A1 (Hinton et al.) or WO2015107026. Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434 by EU numbering, e.g., substitution of Fc region residue 434 (U.S. Pat. No. 7,371,826).

In some embodiments, the Fc region of a CD80-Fc variant fusion comprises one or more amino acid substitution E356D and M358L. In some embodiments, the Fc region of a CD80-Fc variant fusion comprises one or more amino acid substitutions C220S, C226S, C229S. In some embodiments, the Fc region of a CD80 variant fusion comprises one or more amino acid substitutions R292C and V302C. See also Duncan & Winter, *Nature* 322:738-40 (1988); U.S. Pat. Nos. 5,648,260; 5,624,821; and WO 94/29351 concerning other examples of Fc region variants.

In some embodiments, alterations are made in the Fc region that result in diminished C1q binding and/or Complement Dependent Cytotoxicity (CDC), e.g., as described in U.S. Pat. No. 6,194,551, WO 99/51642, and Idusogie et al., *J. Immunol.* 164: 4178-4184 (2000).

In some embodiments, there is provided a CD80-Fc variant fusion comprising a variant Fc region comprising one or more amino acid modifications, wherein the variant Fc region is derived from IgG1, such as human IgG1. In some embodiments, the variant Fc region is derived from the amino acid sequence set forth in SEQ ID NO: 226. In some embodiments, the Fc contains at least one amino acid substitution that is N82G by numbering of SEQ ID NO: 226 (corresponding to N297G by EU numbering). In some embodiments, the Fc further contains at least one amino acid substitution that is R77C or V87C by numbering of SEQ ID NO: 226 (corresponding to R292C or V302C by EU numbering). In some embodiments, the variant Fc region further comprises a C5S amino acid modification by numbering of SEQ ID NO: 226 (corresponding to C220S by EU numbering). For example, in some embodiments, the variant Fc region comprises the following amino acid modifications:

N82G and one or more of the following amino acid modifications C5S, R77C or V87C with reference to SEQ ID NO:226.

In some embodiments, there is provided a CD80-Fc variant fusion comprising a variant Fc region in which the variant Fc comprises the sequence of amino acids set forth in any of SEQ ID NOS:389, 392-394 and 413, or a sequence of amino acids that exhibits at least 85%, 86%, 87%, 88%, 89%, 90%, 91%, 92%, 93%, 94%, 95%, 96%, 97%, 98%, 99% or more sequence identity to any of SEQ ID NOS: 389, 392-394 and 413.

In some embodiments, the Fc is derived from IgG2, such as human IgG2. In some embodiments, the Fc comprises the amino acid sequence set forth in SEQ ID NO: 227 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 227.

In some embodiments, the Fc comprises the amino acid sequence set forth in SEQ ID NO: 411 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 411. In some embodiments, the IgG4 Fc is a stabilized Fc in which the CH3 domain of human IgG4 is substituted with the CH3 domain of human IgG1 and which exhibits inhibited aggregate formation, an antibody in which the CH3 and CH2 domains of human IgG4 are substituted with the CH3 and CH2 domains of human IgG1, respectively, or an antibody in which arginine at position 409 indicated in the EU index proposed by Kabat et al. of human IgG4 is substituted with lysine and which exhibits inhibited aggregate formation (see e.g. U.S. Pat. No. 8,911,726). In some embodiments, the Fc is an IgG4 containing the S228P mutation, which has been shown to prevent recombination between a therapeutic antibody and an endogenous IgG4 by Fab-arm exchange (see e.g. Labrijin et al. (2009) Nat. Biotechnol., 27(8)767-71.) In some embodiments, the Fc comprises the amino acid sequence set forth in SEQ ID NO: 412 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 412.

In some embodiments, the variant CD80 polypeptide is directly linked to the Fc sequence. In some embodiments, the variant CD80 polypeptide is indirectly linked to the Fc sequence, such as via a linker. In some embodiments, one or more "peptide linkers" link the variant CD80 polypeptide and the Fc domain. In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. In some embodiments, the linker is (in one-letter amino acid code): GGGGS ("4GS") or multimers of the 4GS linker, such as repeats of 2, 3, 4, or 5 4GS linkers.

In some embodiments, the variant CD80-Fc fusion protein is a dimer formed by two variant CD80 Fc polypeptides linked to an Fc domain. In some specific embodiments, identical or substantially identical species (allowing for 3 or fewer N-terminus or C-terminus amino acid sequence differences) of CD80-Fc variant fusion polypeptides will be dimerized to create a homodimer. In some embodiments, the dimer is a homodimer in which the two variant CD80 Fc polypeptides are the same. Alternatively, different species of CD80-Fc variant fusion polypeptides can be dimerized to yield a heterodimer. Thus, in some embodiments, the dimer is a heterodimer in which the two variant CD80 Fc polypeptides are different.

Also provided are nucleic acid molecules encoding the variant CD80-Fc fusion protein. In some embodiments, for production of an Fc fusion protein, a nucleic acid molecule encoding a variant CD80-Fc fusion protein is inserted into an appropriate expression vector. The resulting variant CD80-Fc fusion protein can be expressed in host cells transformed with the expression where assembly between Fc domains occurs by interchain disulfide bonds formed between the Fc moieties to yield dimeric, such as divalent, variant CD80-Fc fusion proteins.

The resulting Fc fusion proteins can be easily purified by affinity chromatography over Protein A or Protein G columns. For the generation of heterodimers, additional steps for purification can be necessary. For example, where two nucleic acids encoding different variant CD80 polypeptides are transformed into cells, the formation of heterodimers must be biochemically achieved since variant CD80 molecules carrying the Fc-domain will be expressed as disulfide-linked homodimers as well. Thus, homodimers can be reduced under conditions that favor the disruption of interchain disulfides, but do no effect intra-chain disulfides. In some cases, different variant-CD80 Fc monomers are mixed in equimolar amounts and oxidized to form a mixture of homo- and heterodimers. The components of this mixture are separated by chromatographic techniques. Alternatively, the formation of this type of heterodimer can be biased by genetically engineering and expressing Fc fusion molecules that contain a variant CD80 polypeptide using knob-into-hole methods described below.

B. Stack Molecules with Additional IgSF Domains

In some embodiments, the immunomodulatory proteins can contain any of the variant CD80 polypeptides provided herein linked, directly or indirectly, to one or more other immunoglobulin superfamily (IgSF) domain ("stacked" immunomodulatory protein construct and also called a "Type II" immunomodulatory protein). In some aspects, this can create unique multi-domain immunomodulatory proteins that bind two or more, such as three or more, cognate binding partners, thereby providing a multi-targeting modulation of the immune synapse.

In some embodiments, an immunomodulatory protein comprises a combination (a "non-wild-type combination") and/or arrangement (a "non-wild type arrangement" or "non-wild-type permutation") of a variant CD80 domain with one or more other affinity modified and/or non-affinity modified IgSF domain sequences of another IgSF family member (e.g. a mammalian IgSF family member) that are not found in wild-type IgSF family members. In some embodiments, the immunomodulatory protein contains 2, 3, 4, 5 or 6 immunoglobulin superfamily (IgSF) domains, where at least one of the IgSF domain is a variant CD80 IgSF domain (vIgD of CD80) according to the provided description.

In some embodiments, the sequences of the additional IgSF domains can be a modified IgSF domain that contains one or more amino acid modifications, e.g. substitutions, compared to a wildtype or unmodified IgSF domain. In some embodiments, the IgSF domain can be non-affinity modified (e.g., wild-type) or have been affinity modified. In some embodiments, the unmodified or wild-type IgSF domain can be from mouse, rat, cynomolgus monkey, or human origin, or combinations thereof. In some embodiments, the additional IgSF domains can be an IgSF domain of an IgSF family member set forth in Table 2. In some embodiments, the additional IgSF domain can be an affinity-modified IgSF domain containing one or more amino acid modifications, e.g. substitutions, compared to an IgSF domain contained in an IgSF family member set forth in Table 2.

In some embodiments, the additional IgSF domain is an affinity or non-affinity modified IgSF domain contained in an IgSF family member of a family selected from Signal-Regulatory Protein (SIRP) Family, Triggering Receptor Expressed On Myeloid Cells Like (TREML) Family, Carcinoembryonic Antigen-related Cell Adhesion Molecule (CEACAM) Family, Sialic Acid Binding Ig-Like Lectin (SIGLEC) Family, Butyrophilin Family, B7 family, CD28 family, V-set and Immunoglobulin Domain Containing (VSIG) family, V-set transmembrane Domain (VS™) family, Major Histocompatibility Complex (MHC) family, Signaling lymphocytic activation molecule (SLAM) family, Leukocyte immunoglobulin-like receptor (LIR), Nectin (Nec) family, Nectin-like (NECL) family, Poliovirus receptor related (PVR) family, Natural cytotoxicity triggering receptor (NCR) family, T cell immunoglobulin and mucin (TIM) family or Killer-cell immunoglobulin-like receptors (KIR) family. In some embodiments, the additional IgSF domains are independently derived from an IgSF protein selected from the group consisting of CD80(B7-1), CD86 (B7-2), CD274 (PD-L1, B7-H1), PDCD1LG2(PD-L2, CD273), ICOSLG(B7RP1, CD275, ICOSL, B7-H2), CD276(B7-H3), VTCN1(B7-H4), CD28, CTLA-4, PDCD1 (PD-1), ICOS, BTLA(CD272), CD4, CD8A(CD8-alpha), CD8B(CD8-beta), LAG3, HAVCR2(TIM-3), CEACAM1, TIGIT, PVR(CD155), PVRL2(CD112), CD226, CD2, CD160, CD200, CD200R1(CD200R), and NC R3 (NKp30).

The first column of Table 2 provides the name and, optionally, the name of some possible synonyms for that particular IgSF member. The second column provides the protein identifier of the UniProtKB database, a publicly available database accessible via the internet at uniprot.org or, in some cases, the GenBank Number. The Universal Protein Resource (UniProt) is a comprehensive resource for protein sequence and annotation data. The UniProt databases include the UniProt Knowledgebase (UniProtKB). UniProt is a collaboration between the European Bioinformatics Institute (EMBL-EBI), the SIB Swiss Institute of Bioinformatics and the Protein Information Resource (PIR) and supported mainly by a grant from the U.S. National Institutes of Health (NIH). GenBank is the NIH genetic sequence database, an annotated collection of all publicly available DNA sequences (Nucleic Acids Research, 2013 January; 41(D1):D36-42). The third column provides the region where the indicated IgSF domain is located. The region is specified as a range where the domain is inclusive of the residues defining the range. Column 3 also indicates the IgSF domain class for the specified IgSF region. Colum 4 provides the region where the indicated additional domains are located (signal peptide, S; extracellular domain, E; transmembrane domain, T; cytoplasmic domain, C). It is understood that description of domains can vary depending on the methods used to identify or classify the domain, and may be identified differently from different sources. The description of residues corresponding to a domain in Table 2 is for exemplification only and can be several amino acids (such as one, two, three or four) longer or shorter. Column 5 indicates for some of the listed IgSF members, some of its cognate cell surface binding partners.

TABLE 2

IgSF members according to the present disclosure.

| | | | | | IgSF Member Amino Acid Sequence (SEQ ID NO) | | |
|---|---|---|---|---|---|---|---|
| IgSF Member (Synonym) | UniProtKB Protein Identifier | IgSF Region & Domain Class | Other Domains Binding | Cognate Cell Surface Partners | Precursor (mature residues) | Mature | ECD |
| CD80 (B7-1) | NP_005182.1 P33681 | 35-135, 35-138, 37-138, or 35-141 IgV, 145-230 or 154-232 IgC | S: 1-34, E: 35-242, T: 243-263, C: 264-288 | CD28, CTLA-4, PD-L1 | SEQ ID NO: 1 (35-288) | SEQ ID NO: 253 | SEQ ID NO: 28 |
| CD86 (B7-2) | P42081.2 | 33-131 IgV, 150-225 IgC2 | S: 1-23, E: 24-247, T: 248-268, C: 269-329 | CD28, CTLA-4 | SEQ ID NO: 2 (24-329) | SEQ ID NO: 254 | SEQ ID NO: 29 |
| CD274 (PD-L1, B7-H1) | Q9NZQ7.1 | 24-130 IgV, 133-225 IgC2 | S: 1-18, E: 19-238, T: 239-259, C: 260-290 | PD-1, B7-1 | SEQ ID NO: 3 (19-290) | SEQ ID NO: 255 | SEQ ID NO: 30 |
| PDCD1LG2 (PD-L2, CD273) | Q9BQ51.2 | 21-118 IgV, 122-203 IgC2 | S: 1-19, E: 20-220, T: 221-241, C: 242-273 | PD-1, RGMb | SEQ ID NO: 4 (20-273) | SEQ ID NO: 256 | SEQ ID NO: 31 |
| ICOSLG (B7RP1, CD275, ICOSL, B7-H2) | O75144.2 | 19-129 IgV, 141-227 IgC2 | S: 1-18 E: 19-256, T: 257-277, C: 278-302 | ICOS, CD28, CTLA-4 | SEQ ID NO: 5 (19-302) | SEQ ID NO: 257 | SEQ ID NO: 32 |
| CD276 (B7-H3) | Q5ZPR3.1 | 29-139 IgV, 145-238 IgC2, 243-357 IgV, 367-453 IgC | S: 1-28, E: 29-466, T: 467-487, C: 488-534 | | SEQ ID NO: 6 (29-534) | SEQ ID NO: 258 | SEQ ID NO: 33 |
| VTCN1 (B7-H4) | Q7Z7D3.1 | 35-146 IgV, 153-241 IgV | S: 1-24, E: 25-259, T: 260-280, C: 281-282 | | SEQ ID NO: 7 (25-282) | SEQ ID NO: 259 | SEQ ID NO: 34 |

TABLE 2-continued

IgSF members according to the present disclosure.

| IgSF Member (Synonym) | UniProtKB Protein Identifier | IgSF Region & Domain Class | Other Domains Binding | Cognate Cell Surface Partners | IgSF Member Amino Acid Sequence (SEQ ID NO) Precursor (mature residues) | Mature | ECD |
|---|---|---|---|---|---|---|---|
| CD28 | P10747.1 | 28-137 IgV | S: 1-18, E: 19-152, T: 153-179, C: 180-220 | B7-1, B7-2, B7RP1 | SEQ ID NO: 8 (19-220) | SEQ ID NO: 260 | SEQ ID NO: 35 |
| CTLA-4 | P16410.3 | 39-140 IgV | S: 1-35, E: 36-161, T: 162-182, C: 183-223 | B7-1, B7-2, B7RP1 | SEQ ID NO: 9 (36-223) | SEQ ID NO: 261 | SEQ ID NO: 36 |
| PDCD1 (PD-1) | Q15116.3 | 35-145 IgV | S: 1-20, E: 21-170, T: 171-191, C: 192-288 | PD-L1, PD-L2 | SEQ ID NO: 10 (21-288) | SEQ ID NO: 262 | SEQ ID NO: 37 |
| ICOS | Q9Y6W8.1 | 30-132 IgV | S: 1-20, E: 21-140, T: 141-161, C: 162-199 | B7RP1 | SEQ ID NO: 11 (21-199) | SEQ ID NO: 263 | SEQ ID NO: 38 |
| BTLA (CD272) | Q7Z6A9.3 | 31-132 IgV | S: 1-30, E: 31-157, T: 158-178, C: 179-289 | HVEM | SEQ ID NO: 12 (31-289) | SEQ ID NO: 264 | SEQ ID NO: 39 |
| CD4 | P01730.1 | 26-125 IgV, 126-203 IgC2, 204-317 IgC2, 317-389 IgC2 | S: 1-25, E: 26-396, T: 397-418, C: 419-458 | MHC class II | SEQ ID NO: 13 (26-458) | SEQ ID NO: 265 | SEQ ID NO: 40 |
| CD8A (CD8-alpha) | P01732.1 | 22-135 IgV | S: 1-21, E: 22-182, T: 183-203, C: 204-235 | MHC class I | SEQ ID NO: 14 (22-235) | SEQ ID NO: 266 | SEQ ID NO: 41 |
| CD8B (CD8-beta) | P10966.1 | 22-132 IgV | S: 1-21, E: 22-170, T: 171-191, C: 192-210 | MHC class I | SEQ ID NO: 15 (22-210) | SEQ ID NO: 267 | SEQ ID NO: 42 |
| LAG3 | P18627.5 | 37-167 IgV, 168-252 IgC2, 265-343 IgC2, 349-419 IgC2 | s: 1-28, E: 29-450, T: 451-471, C: 472-525 | MHC class II | SEQ ID NO: 16 (29-525) | SEQ ID NO: 268 | SEQ ID NO: 43 |
| HAVCR2 (TIM-3) | Q8TDQ0.3 | 22-124 IgV | S: 1-21, E: 22-202, T: 203-223, C: 224-301 | CEACAM-1, phosphatidylserine, Galectin-9, HMGB1 | SEQ ID NO: 17 (22-301) | SEQ ID NO: 269 | SEQ ID NO: 44 |
| CEACAM1 | P13688.2 | 35-142 IgV, 145-232 IgC2, 237-317 IgC2, 323-413 IgC | S: 1-34, E: 35-428, T: 429-452, C: 453-526 | TIM-3 | SEQ ID NO: 18 (35-526) | SEQ ID NO: 270 | SEQ ID NO: 45 |
| TIGIT | Q495A1.1 | 22-124 IgV | S: 1-21, E: 22-141, T: 142-162, C: 163-244 | CD155, CD112 | SEQ ID NO: 19 (22-244) | SEQ ID NO: 271 | SEQ ID NO: 46 |
| PVR (CD155) | P15151.2 | 24-139 IgV, 145-237 IgC2, 244-328 IgC2 | S: 1-20, E: 21-343, T: 344-367, C: 368-417 | TIGIT, CD226, CD96, poliovirus | SEQ ID NO: 20 (21-417) | SEQ ID NO: 272 | SEQ ID NO: 47 |
| PVRL2 (CD112) | Q92692.1 | 32-156 IgV, 162-256 IgC2, 261-345 IgC2 | S: 1-31, E: 32-360, T: 361-381, C: 382-538 | TIGIT, CD226, CD112R | SEQ ID NO: 21 (32-538) | SEQ ID NO: 273 | SEQ ID NO: 48 |
| CD226 | Q15762.2 | 19-126 IgC2, 135-239 IgC2 | S: 1-18, E: 19-254, T: 255-275, C: 276-336 | CD155, CD112 | SEQ ID NO: 22 (19-336) | SEQ ID NO: 274 | SEQ ID NO: 49 |
| CD2 | P06729.2 | 25-128 IgV, 129-209 IgC2 | S: 1-24, E: 25-209, T: 210-235, C: 236-351 | CD58 | SEQ ID NO: 23 (25-351) | SEQ ID NO: 275 | SEQ ID NO: 50 |
| CD160 | 095971.1 | 27-122 IgV | S: 1-26 E: 27-122 | HVEM, MHC family of proteins | SEQ ID NO: 24 (27-159) | SEQ ID NO: 276 | SEQ ID NO: 51 |
| CD200 | P41217.4 | 31-141 IgV, 142-232 IgC2 | S: 1-30, E: 31-232, T: 233-259, C: 260-278 | CD200R | SEQ ID NO: 25 (31-278) | SEQ ID NO: 277 | SEQ ID NO: 52 |

TABLE 2-continued

IgSF members according to the present disclosure.

| IgSF Member (Synonym) | UniProtKB Protein Identifier | IgSF Region & Domain Class | Other Domains Binding | Cognate Cell Surface Partners | IgSF Member Amino Acid Sequence (SEQ ID NO) Precursor (mature residues) | Mature | ECD |
|---|---|---|---|---|---|---|---|
| CD200R1 (CD200R) | Q8TD46.2 | 53-139 IgV, 140-228 IgC2 | S: 1-28, E: 29-243, T: 244-264, C: 265-325 | CD200 | SEQ ID NO: 26 (29-325) | SEQ ID NO: 278 | SEQ ID NO: 53 |
| NCR3 (NKp30) | 014931.1 | 19-126 IgC-like | S: 1-18, E: 19-135, T: 136-156, C: 157-201 | B7-H6 | SEQ ID NO: 27 (19-201) | SEQ ID NO: 279 | SEQ ID NO: 54 |
| VSIG8 | Q5VU13 | 22-141 IgV 1 146-257 IgV 2 | S: 1-21 E: 22-263 T: 264-284 C: 285-414 | VISTA | SEQ ID NO: 348 (22-414) | SEQ ID NO: 349 | SEQ ID NO: 350 |

The number of such non-affinity modified or affinity modified IgSF domains present in a “stacked” immunomodulatory protein construct (whether non-wild type combinations or non-wild type arrangements) is at least 2, 3, 4, or 5 and in some embodiments exactly 2, 3, 4, or 5 IgSF domains (whereby determination of the number of affinity modified IgSF domains disregards any non-specific binding fractional sequences thereof and/or substantially immunologically inactive fractional sequences thereof).

In some embodiments of a stacked immunomodulatory protein provided herein, the number of IgSF domains is at least 2 wherein the number of affinity modified and the number of non-affinity modified IgSF domains is each independently at least: 0, 1, 2, 3, 4, 5, or 6. Thus, the number of affinity modified IgSF domains and the number of non-affinity modified IgSF domains, respectively, (affinity modified IgSF domain: non-affinity modified IgSF domain), can be exactly or at least: 2:0 (affinity modified: wild-type), 0:2, 2:1, 1:2, 2:2, 2:3, 3:2, 2:4, 4:2, 1:1, 1:3, 3:1, 1:4, 4:1, 1:5, or 5:1.

In some embodiments of a stacked immunomodulatory protein, at least two of the non-affinity modified and/or affinity modified IgSF domains are identical IgSF domains.

In some embodiments, a stacked immunomodulatory protein provided herein comprises at least two affinity modified and/or non-affinity modified IgSF domains from a single IgSF member but in a non-wild-type arrangement (alternatively, “permutation”). One illustrative example of a non-wild type arrangement or permutation is an immunomodulatory protein comprising a non-wild-type order of affinity modified and/or non-affinity modified IgSF domain sequences relative to those found in the wild-type CD80 whose IgSF domain sequences served as the source of the variant IgSF domains as provided herein. Thus, in one example, the immunomodulatory protein can comprise an IgV proximal and an IgC distal to the transmembrane domain albeit in a non-affinity modified and/or affinity modified form. The presence, in an immunomodulatory protein provided herein, of both non-wild-type combinations and non-wild-type arrangements of non-affinity modified and/or affinity modified IgSF domains, is also within the scope of the provided subject matter.

In some embodiments of a stacked immunomodulatory protein, the non-affinity modified and/or affinity modified IgSF domains are non-identical (i.e., different) IgSF domains. Non-identical affinity modified IgSF domains specifically bind, under specific binding conditions, different cognate binding partners and are “non-identical” irrespective of whether or not the wild-type or unmodified IgSF domains from which they are engineered was the same. Thus, for example, a non-wild-type combination of at least two non-identical IgSF domains in an immunomodulatory protein can comprise at least one IgSF domain sequence whose origin is from and unique to one CD80, and at least one of a second IgSF domain sequence whose origin is from and unique to another IgSF family member that is not CD80, wherein the IgSF domains of the immunomodulatory protein are in non-affinity modified and/or affinity modified form. However, in alternative embodiments, the two non-identical IgSF domains originate from the same IgSF domain sequence but at least one is affinity modified such that they specifically bind to different cognate binding partners.

In some embodiments, the provided immunomodulatory proteins, in addition to containing a variant CD80 polypeptide, also contains at least 2, 3, 4, 5 or 6 additional immunoglobulin superfamily (IgSF) domains, such as an IgD domain of an IgSF family member set forth in Table 2. In some embodiments, the provided immunomodulatory proteins contains at least one additional IgSF domain (e.g. a second IgSF domain) in which at least one additional or second IgSF domain is an IgSF domain set forth in a wild-type or unmodified IgSF domain or a specific binding fragment thereof contained in the sequence of amino acids set forth in any of SEQ ID NOS: 1-27 and 348. In some embodiments, the wild-type or unmodified IgSF domain is an IgV domain or an IgC domain, such as an IgC1 or IgC2 domain.

In some embodiments, the provided immunomodulatory proteins, in addition to containing a variant CD80 polypeptide, also contains at least one additional IgSF domain (e.g. a second IgSF domain) that is a vIgD that contains one or more amino acid modifications (e.g. substitution, deletion or mutation) compared to an IgSF domain in a wild-type or unmodified IgSF domain, such as an IgSF domain in an IgSF family member set forth in Table 2. In some embodiments, the additional or second affinity-modified IgSF domain comprises at least 85%, 86%, 87%, 88%, 89%, 90%, 91%, 92%, 93%, 94%, 95%, 96%, 97%, 98%, 99% or more sequence identity to a wild-type or unmodified IgSF domain or a specific binding fragment thereof contained in the sequence of amino acids set forth in any of SEQ ID NOS:

1-27 and 348. In some embodiments, the wild-type or unmodified IgSF domain is an IgV domain or an IgC domain, such as an IgC1 or IgC2 domain. In some embodiments, the additional or second IgSF domain is an affinity-modified IgV domain or IgC domain.

In some embodiments, the one or more additional IgSF domain (e.g. second IgSF) domain is an IgSF domain (e.g. IgV) of another IgSF family member that binds or recognizes a tumor antigen. In such embodiments, the IgSF family member serves as a tumor-localizing moiety, thereby bringing the vIgD of CD80 in close proximity to immune cells in the tumor microenvironment. In some embodiments, the additional IgSF domain (e.g. second IgSF) domain is an IgSF domain of NkP30, which binds or recognizes B7-H6 expressed on a tumor cell. In some embodiments, the at least one additional (e.g. second) IgSF domain, e.g. NkP30, is a vIgD that contains one or more amino acid modifications (e.g. substitutions, deletions or additions). In some embodiments, the one or more amino acid modifications increase binding affinity and/or selectivity to B7-H6 compared to unmodified IgSF domain, e.g. NkP30, such as by at least or at least about 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. Among the exemplary polypeptides is an NKp30 variant that contains the mutations L30V/A60V/S64P/S86G with reference to positions in the NKp30 extracellular domain corresponding to positions set forth in SEQ ID NO:54.

Tables 3-5 provide exemplary polypeptides containing one or more affinity-modified IgSF domains that can be used in stack constructs provided herein.

TABLE 3

Exemplary variant ICOSL polypeptides

| Mutation(s) | ECD SEQ ID NO | IgV SEQ ID NO |
|---|---|---|
| Wild-type | 32 | 196 |
| N52S | 109 | 197 |
| N52H | 110 | 198 |
| N52D | 111 | 199 |
| N52Y/N57Y/F138L/L203P | 112 | 200 |
| N52H/N57Y/Q100P | 113 | 201 |
| N52S/Y146C/Y152C | 114 | |
| N52H/C198R | 115 | |
| N52H/C140D/T225A | 116 | |
| N52H/C198R/T225A | 117 | |
| N52H/K92R | 118 | 202 |
| N52H/S99G | 119 | 203 |
| N52Y | 120 | 204 |
| N57Y | 121 | 205 |
| N57Y/Q100P | 122 | 206 |
| N52S/S130G/Y152C | 123 | |
| N52S/Y152C | 124 | |
| N52S/C198R | 125 | |
| N52Y/N57Y/Y152C | 126 | |
| N52Y/N57Y/H129P/C198R | 127 | |
| N52H/L161P/C198R | 128 | |
| N52S/T113E | 129 | |
| S54A | 130 | 207 |
| N52D/S54P | 131 | 208 |
| N52K/L208P | 132 | 209 |
| N52S/Y152H | 133 | |
| N52D/V151A | 134 | |
| N52H/I143T | 135 | |
| N52S/L80P | 136 | 210 |
| F120S/Y152H/N201S | 137 | |
| N52S/R75Q/L203P | 138 | 211 |
| N52S/D158G | 139 | |
| N52D/Q133H | 140 | |

TABLE 3-continued

Exemplary variant ICOSL polypeptides

| Mutation(s) | ECD SEQ ID NO | IgV SEQ ID NO |
|---|---|---|
| N52S/N57Y/H94D/L96F/L98F/Q100R | 141 | 212 |
| N52S/N57Y/H94D/L96F/L98F/Q100R/G103E/F120S | 142 | 213 |
| N52S/G103E | 239 | 240 |
| N52H/C140del/T225A | 478 | |

TABLE 4

Exemplary variant NKp30 polypeptides

| Mutation(s) | ECD SEQ ID NO | IgC-like domain SEQ ID NO |
|---|---|---|
| Wild-type | 54 | 214 |
| L30V/A60V/S64P/S86G | 143 | 215 |
| L30V | 144 | 216 |
| A60V | 145 | 217 |
| S64P | 146 | 218 |
| S86G | 147 | 219 |

TABLE 5

Exemplary variant CD86 polypeptides

| Mutation(s) | ECD SEQ ID NO | IgV SEQ ID NO |
|---|---|---|
| Wild-type | 29 | 220 |
| Q35H/H90L/Q102H | 148 | 221 |
| Q35H | 149 | 222 |
| H90L | 150 | 223 |
| Q102H | 151 | 224 |

In some embodiments, the two or more IgSF domain, including a vIgD of CD80 and one or more additional IgSF domain (e.g. second variant IgSF domain) from another IgSF family member, are covalently or non-covalently linked. A plurality of non-affinity modified and/or affinity modified IgSF domains in a stacked immunomodulatory protein polypeptide chain need not be covalently linked directly to one another. In some embodiments, the two or more IgSF domains are linked directly or indirectly, such as via a linker. In some embodiments, an intervening span of one or more amino acid residues indirectly covalently bonds IgSF domains to each other. The linkage can be via the N-terminal to C-terminal residues. In some embodiments, the linkage can be made via side chains of amino acid residues that are not located at the N-terminus or C-terminus of the IgSF domain(s). Thus, linkages can be made via terminal or internal amino acid residues or combinations thereof.

In some embodiments, one or more "peptide linkers" link the vIgD of CD80 and an additional IgSF domain (e.g. second variant IgSF domain). In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. In some embodiments, the linker is (in one-letter amino acid code): GGGGS ("4GS") or multimers of the 4GS linker, such as repeats of 2, 3, 4, or 5 4GS linkers. In some embodiments, the peptide linker is $(GGGGS)_2$ or $(GGGGS)_3$. In some embodiments, the linker also can include a series of alanine residues alone or in addition to another peptide linker (such as a 4GS linker or multimer thereof). In some embodiments, the number of alanine residues in each series is: 2, 3, 4, 5, or 6 alanines.

In some embodiments, the non-affinity modified and/or affinity modified IgSF domains are linked by "wild-type peptide linkers" inserted at the N-terminus and/or C-terminus of the first and/or second non-affinity modified and/or affinity modified IgSF domains. These linkers are also called leading sequences (N-terminal to non-affinity modified or affinity modified IgSF domain) or trailing sequences (C-terminal to non-affinity modified or affinity modified IgSF domain), and sequences that exist in the wild-type protein that span immediately outside the structural prediction of the Ig fold of the IgSF. In some embodiments, the "wild-type linker" is an amino acid sequence that exists after the signal sequence, but before in the IgSF domain, such as the defined IgV domain, in the amino acid sequence of the wild-type protein. In some embodiments, the "wild-type" linker is an amino acid sequence that exists immediately after the IgSF domain, such as immediately after the defined IgV domain but before the IgC domain, in the amino acid sequence of the wild-type protein. These linker sequences can contribute to the proper folding and function of the neighboring IgSF domain(s). In some embodiments, there is present a leading peptide linker inserted at the N-terminus of the first IgSF domain and/or a trailing sequence inserted at the C-terminus of the first non-affinity modified and/or affinity modified IgSF domain. In some embodiments, there is present a second leading peptide linker inserted at the N-terminus of the second IgSF domain and/or a second trailing sequence inserted at the C-terminus of the second non-affinity modified and/or affinity modified IgSF domain. When the first and second non-affinity modified and/or affinity modified IgSF domains are derived from the same parental protein and are connected in the same orientation, wild-type peptide linkers between the first and second non-affinity modified and/or affinity modified IgSF domains are not duplicated. For example, when the first trailing wild-type peptide linker and the second leading wild-type peptide linker are the same, the Type II immunomodulatory protein does not comprise either the first trailing wild-type peptide linker or the second leading wild-type peptide linker.

In some embodiments, the Type II immunomodulatory protein comprises a first leading wild-type peptide linker inserted at the N-terminus of the first non-affinity modified and/or affinity modified IgSF domain, wherein the first leading wild-type peptide linker comprises at least 5 (such as at least about any of 6, 7, 8, 9, 10, 11, 12, 13, 14, 15, or more) consecutive amino acids from the intervening sequence in the wild-type protein from which the first non-affinity modified and/or affinity modified IgSF domain is derived between the parental IgSF domain and the immediately preceding domain (such as a signal peptide or an IgSF domain). In some embodiments, the first leading wild-type peptide linker comprises the entire intervening sequence in the wild-type protein from which the first non-affinity modified and/or affinity modified IgSF domain is derived between the parental IgSF domain and the immediately preceding domain (such as a signal peptide or an IgSF domain).

In some embodiments, the Type II immunomodulatory protein further comprises a first trailing wild-type peptide linker inserted at the C-terminus of the first non-affinity modified and/or affinity modified IgSF domain, wherein the first trailing wild-type peptide linker comprises at least 5 (such as at least about any of 6, 7, 8, 9, 10, 11, 12, 13, 14, 15, or more) consecutive amino acids from the intervening sequence in the wild-type protein from which the first non-affinity modified and/or affinity modified IgSF domain is derived between the parental IgSF domain and the immediately following domain (such as an IgSF domain or a transmembrane domain). In some embodiments, the first trailing wild-type peptide linker comprises the entire intervening sequence in the wild-type protein from which the first non-affinity modified and/or affinity modified IgSF domain is derived between the parental IgSF domain and the immediately following domain (such as an IgSF domain or a transmembrane domain).

In some embodiments, the Type II immunomodulatory protein further comprises a second leading wild-type peptide linker inserted at the N-terminus of the second non-affinity modified and/or affinity modified IgSF domain, wherein the second leading wild-type peptide linker comprises at least 5 (such as at least about any of 6, 7, 8, 9, 10, 11, 12, 13, 14, 15, or more) consecutive amino acids from the intervening sequence in the wild-type protein from which the second non-affinity modified and/or affinity modified IgSF domain is derived between the parental IgSF domain and the immediately preceding domain (such as a signal peptide or an IgSF domain). In some embodiments, the second leading wild-type peptide linker comprises the entire intervening sequence in the wild-type protein from which the second non-affinity modified and/or affinity modified IgSF domain is derived between the parental IgSF domain and the immediately preceding domain (such as a signal peptide or an IgSF domain).

In some embodiments, the Type II immunomodulatory protein further comprises a second trailing wild-type peptide linker inserted at the C-terminus of the second non-affinity modified and/or affinity modified IgSF domain, wherein the second trailing wild-type peptide linker comprises at least 5 (such as at least about any of 6, 7, 8, 9, 10, 11, 12, 13, 14, 15, or more) consecutive amino acids from the intervening sequence in the wild-type protein from which the second non-affinity modified and/or affinity modified IgSF domain is derived between the parental IgSF domain and the immediately following domain (such as an IgSF domain or a transmembrane domain). In some embodiments, the second trailing wild-type peptide linker comprises the entire intervening sequence in the wild-type protein from which the second non-affinity modified and/or affinity modified IgSF domain is derived between the parental IgSF domain and the immediately following domain (such as an IgSF domain or a transmembrane domain).

Exemplary trailing sequences for at Type II protein containing a CD80 IgSF domain, can contain the amino acid sequence set forth in SEQ ID NO: 232. Exemplary trailing sequences for a Type II protein containing a CD80 IgSF domain are set forth in SEQ ID NOS: 231, 232 and 371. Exemplary trailing sequences for a Type II protein containing an ICOSL IgSF domain are set forth in SEQ ID NOS: 233 and 234. Exemplary leading and trailing sequences for a Type II protein containing a CD86 IgSF domain are set forth in SEQ ID NOS: 236-238. An exemplary trailing sequence for a Type II protein containing an NKp30 IgSF domain is set forth in SEQ ID NO:235.

Figure 4:
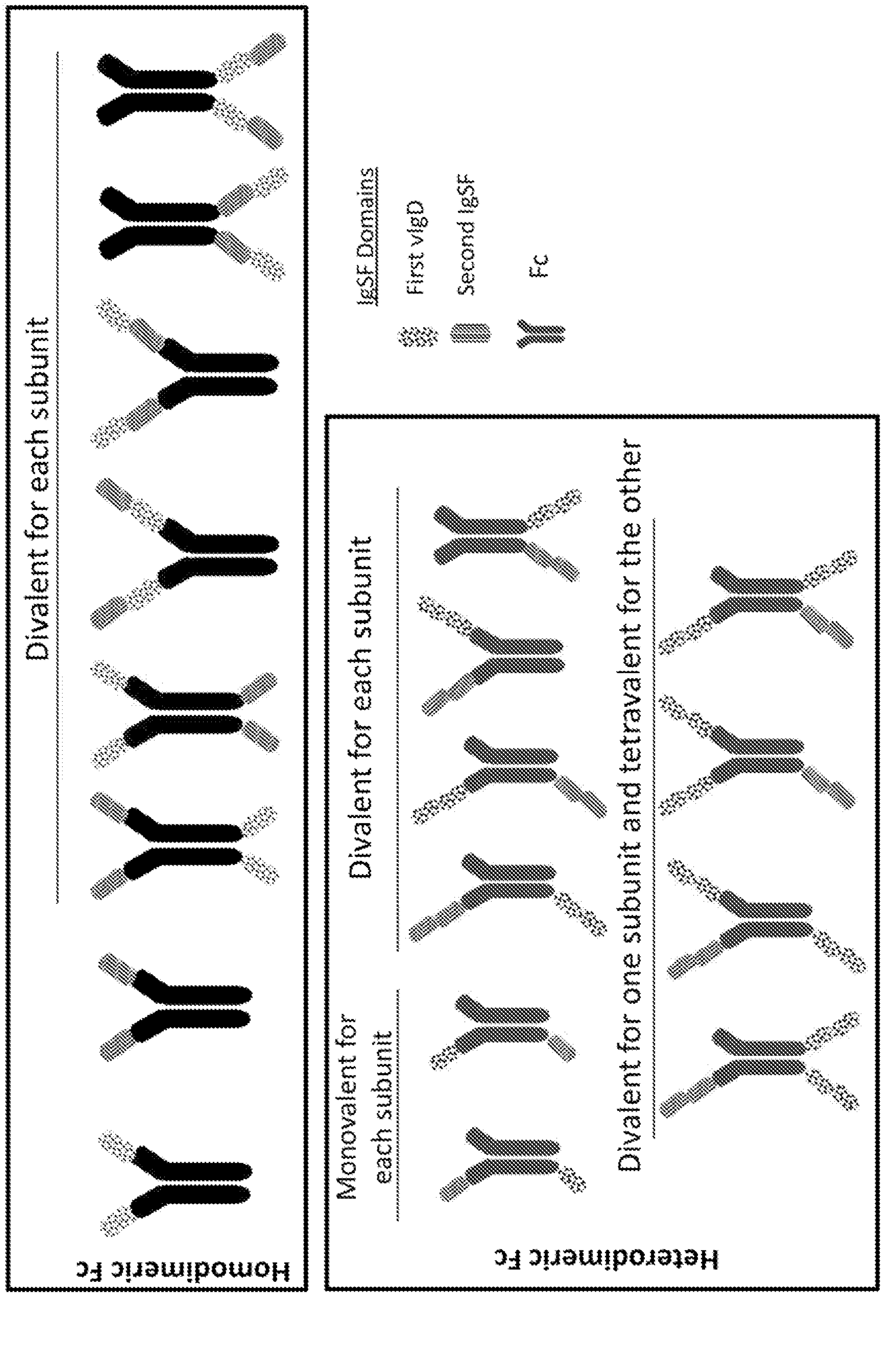
FIG. 4 depicts various exemplary configurations of a stack molecule containing a first variant IgSF domain (first vIgD) and a second IgSF domain, such as a second variant IgSF domain (second vIgD). As shown, the first vIgD and second IgSF domain are independently linked, directly or indirectly, to the N- or C-terminus of an Fc subunit. For generating a homodimeric Fc molecule, the Fc subunit is one that is capable of forming a homodimer with a matched Fc subunit by co-expression of the individual Fc subunits in a cell. For generating a heterodimeric Fc molecule, the individual Fc subunits contain mutations (e.g. "knob-into-hole" mutations in the CH3 domain), such that formation of the heterodimer is favored compared to homodimers when the individual Fc subunits are co-expressed in a cell.
Figure 5:
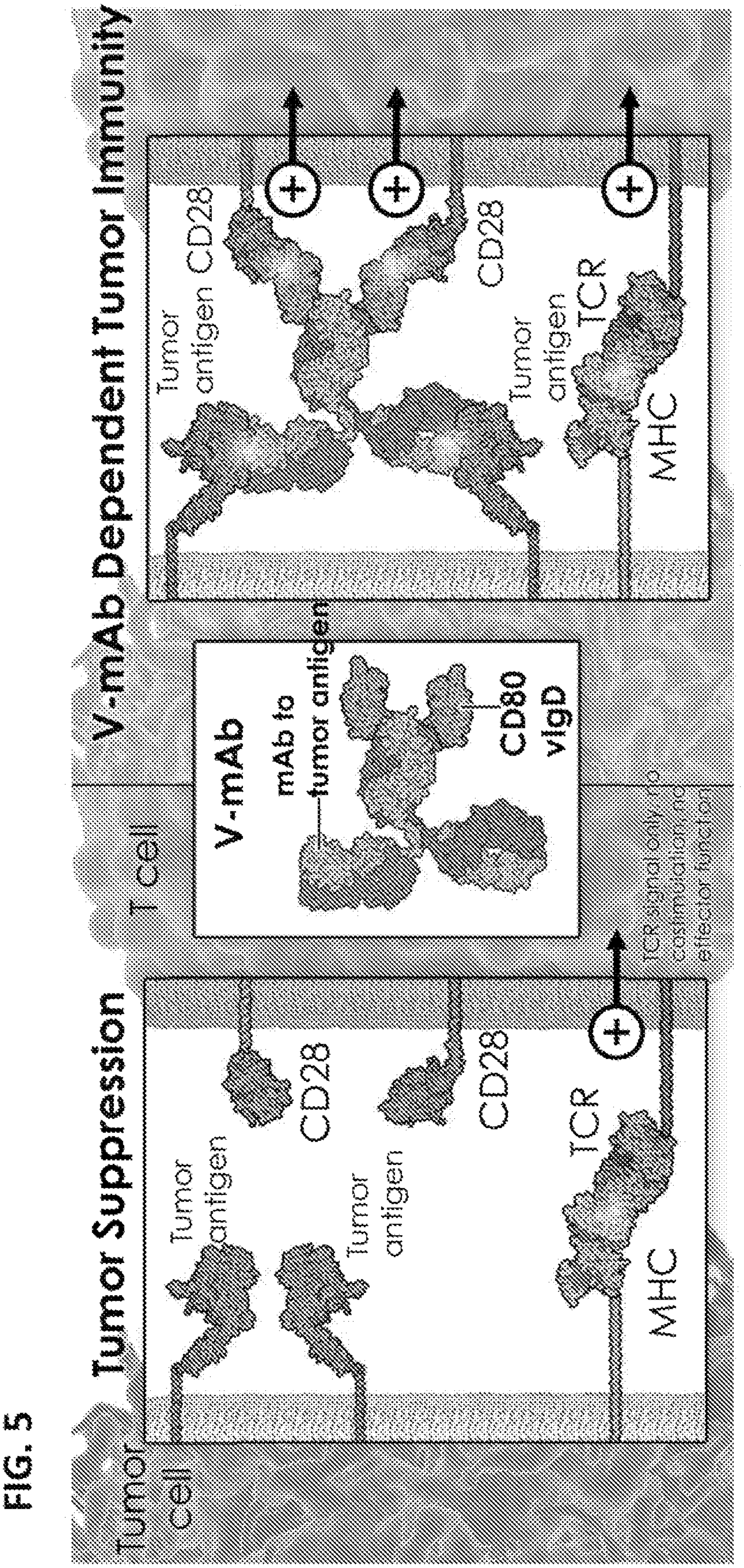
FIG. 5 depicts an exemplary schematic of the activity of a variant IgSF domain (vIgD) conjugated to an antibody (V-Mab) in which the antibody (e.g. anti-HER2 antibody) binds to an antigen on the surface of the tumor cell. In this depiction, the vIgD is a variant of an IgSF domain of CD80. As shown, binding of the antibody to the surface of the tumor cell localizes the vIgD on the tumor cell surface where it can interact with one or more of its cognate binding partners expressed on the surface of an adjacent immune cell (e.g. T cell) to agonize receptor signaling. In an exemplary embodiment as shown, the variant IgSF domain (vIgD) is a variant of an IgSF domain of CD80. Binding of the CD80 vIgD to CD28 costimulatory receptors provides an agonist or costimulatory signal.

In some embodiments, the two or more IgSF domain, including a vIgD of CD80 and one or more additional IgSF domain (e.g. second variant IgSF domain) from another IgSF family member, are linked or attached to an Fc to form a dimeric multi-domain stack immunomodulatory protein. In some embodiments, the variant CD80 polypeptide and second IgSF domain are independently linked, directly or indirectly, to the N- or C-terminus of an Fc subunit. In some embodiments, the variant CD80 polypeptide and second IgSF domain are linked, directly or indirectly, and one of the variant CD80 or second IgSF domain is also linked, directly or indirectly, to the N- or C-terminus of an Fc subunit. In some embodiments, linkage to the Fc is via a peptide linker, e.g. a peptide linker, such as described above. In some embodiments, linkage between the variant CD80 and second IgSF domain is via a peptide linker, e.g. a peptide linker, such as described above. In some embodiments, the vIgD of CD80, the one or more additional IgSF domains, and the Fc domain can be linked together in any of numerous configurations as depicted in FIG. 4. Exemplary configurations are described in the Examples.

In some embodiments, the stacked immunomodulatory protein is a dimer formed by two stacked immunomodulatory Fc fusion polypeptides. Also provided are nucleic acid molecules encoding any of the stacked immunomodulatory proteins. In some embodiments, the dimeric multi-domain stack immunomodulatory protein can be produced in cells by expression, or in some cases co-expression, of stack immunomodulatory Fc fusion polypeptides, such as described above in according with generating dimeric Fc fusion proteins.

In some embodiments, the dimeric multi-domain stack immunomodulatory protein is divalent for each Fc subunit, monovalent for each subunit, or divalent for one subunit and tetravalent for the other.

In some embodiments, the dimeric multi-domain stack immunomodulatory protein is a homodimeric multi-domain stack Fc protein. In some embodiments, the dimeric multi-domain stack immunomodulatory protein comprises a first stack immunomodulatory Fc fusion polypeptide and a second stack immunomodulatory Fc fusion polypeptide in which the first and second polypeptide are the same. In some embodiments, the Fc portion of the polypeptide can be any Fc as described above.

In some embodiments, the multi-domain stack molecule is heterodimeric, comprising two different Fc polypeptides wherein at least one is an Fc polypeptide containing at least one variant CD80 polypeptide and/or at least one second IgSF domain (e.g. second variant IgSF domain). In some embodiments, the multi-domain stack molecule contains a first Fc polypeptide containing a variant CD80 and a second IgSF domain and a second Fc polypeptide containing the variant CD80 and the second IgSF domain. In some embodiments, the multi-domain stack molecule contains a first Fc polypeptide containing a variant CD80 polypeptide and a second IgSF domain and a second Fc polypeptide that is not linked to either a variant CD80 polypeptide or second IgSF domain.

In some embodiments, the multi-domain stack molecule contains a first Fc polypeptides containing 1, 2, 3, 4 or more variant CD80 polypeptides and 1, 2, 3, 4 or more second IgSF domains, wherein the total number of IgSF domains in the first stack Fc polypeptide is greater than 2, 3, 4, 5, 6 or more. In one example of such an embodiment, the second stack Fc polypeptide contains 1, 2, 3, 4 or more variant CD80 polypeptides and 1, 2, 3, 4 or more second IgSF domains, wherein the total number of IgSF domains in the first stack Fc polypeptide is greater than 2, 3, 4, 5, 6 or more. In another example of such an embodiments, the second Fc polypeptide is not linked to either a variant CD80 polypeptide or second IgSF domain.

In some embodiments, the heterodimeric stack molecule contains a first stack immunomodulatory Fc fusion polypeptide and a second stack immunomodulatory Fc fusion polypeptide in which the first and second polypeptide are different. In some embodiments, a heterodimeric stack molecule contains a first Fc subunit containing a first variant CD80 polypeptide and/or second IgSF domain (e.g. second variant IgSF domain) and a second Fc subunit containing the other of the first variant CD80 polypeptide or the second IgSF domain. In some embodiments, the heterodimeric stack molecule contains a first stack immunomodulatory Fc fusion polypeptide and a second stack immunomodulatory Fc fusion polypeptide in which the first and second polypeptide are different. In some embodiments, a heterodimeric stack molecule contains a first Fc subunit containing a first variant CD80 polypeptide and/or second IgSF domain (e.g. second variant IgSF domain) and a second Fc subunit containing both the first variant CD80 polypeptide and second IgSF domain (e.g. second variant IgSF domain) but in a different orientation or configuration from the first Fc subunit.

In some embodiments, the Fc domain of one or both of the first and second stacked immunomodulatory Fc fusion polypeptide comprises a modification (e.g. substitution) such that the interface of the Fc molecule is modified to facilitate and/or promote heterodimerization. In some embodiments, modifications include introduction of a protuberance (knob) into a first Fc polypeptide and a cavity (hole) into a second Fc polypeptide such that the protuberance is positionable in the cavity to promote complexing of the first and second Fc-containing polypeptides. Amino acids targeted for replacement and/or modification to create protuberances or cavities in a polypeptide are typically interface amino acids that interact or contact with one or more amino acids in the interface of a second polypeptide.

In some embodiments, a first polypeptide that is modified to contain protuberance (hole) amino acids include replacement of a native or original amino acid with an amino acid that has at least one side chain which projects from the interface of the first polypeptide and is therefore positionable in a compensatory cavity (hole) in an adjacent interface of a second polypeptide. Most often, the replacement amino acid is one which has a larger side chain volume than the original amino acid residue. One of skill in the art knows how to determine and/or assess the properties of amino acid residues to identify those that are ideal replacement amino acids to create a protuberance. In some embodiments, the replacement residues for the formation of a protuberance are naturally occurring amino acid residues and include, for example, arginine (R), phenylalanine (F), tyrosine (Y), or tyrptophan (W). In some examples, the original residue identified for replacement is an amino acid residue that has a small side chain such as, for example, alanine, asparagines, aspartic acid, glycine, serine, threonine, or valine.

In some embodiments, a second polypeptide that is modified to contain a cavity (hole) is one that includes replacement of a native or original amino acid with an amino acid that has at least one side chain that is recessed from the interface of the second polypeptide and thus is able to accommodate a corresponding protuberance from the interface of a first polypeptide. Most often, the replacement amino acid is one which has a smaller side chain volume than the original amino acid residue. One of skill in the art knows how to determine and/or assess the properties of amino acid residues to identify those that are ideal replacement residues for the formation of a cavity. Generally, the replacement residues for the formation of a cavity are naturally occurring amino acids and include, for example, alanine (A), serine (S), threonine (T) and valine (V). In some examples, the original amino acid identified for replacement is an amino acid that has a large side chain such as, for example, tyrosine, arginine, phenylalanine, or tryptophan.

The CH3 interface of human IgG1, for example, involves sixteen residues on each domain located on four anti-parallel β-strands which buries 1090 Å2 from each surface (see e.g., Deisenhofer et al. (1981) Biochemistry, 20:2361-2370; Miller et al., (1990) J Mol. Biol., 216, 965-973; Ridgway et al., (1996) Prot. Engin., 9: 617-621; U.S. Pat. No. 5,731, 168). Modifications of a CH3 domain to create protuberances or cavities are described, for example, in U.S. Pat. No. 5,731,168; International Patent Applications WO98/50431 and WO 2005/063816; and Ridgway et al., (1996) Prot. Engin., 9: 617-621. In some examples, modifications of a CH3 domain to create protuberances or cavities are typically targeted to residues located on the two central anti-parallel β-strands. The aim is to minimize the risk that the protuberances which are created can be accommodated by protruding into the surrounding solvent rather than being accommodated by a compensatory cavity in the partner CH3 domain.

In some embodiments, the heterodimeric molecule contains a T366W mutation in the CH3 domain of the "knobs chain" and T366S, L368A, Y407V mutations in the CH3 domain of the "hole chain". In some cases, an additional interchain disulfide bridge between the CH3 domains can also be used (Merchant, A. M., et al., Nature Biotech. 16 (1998) 677-681) e.g. by introducing a Y349C mutation into the CH3 domain of the "knobs" or "hole" chain and a E356C mutation or a S354C mutation into the CH3 domain of the other chain. In some embodiments, the heterodimeric molecule contains S354C, T366W mutations in one of the two CH3 domains and Y349C, T366S, L368A, Y407V mutations in the other of the two CH3 domains. In some embodiments, the heterodimeric molecule comprises E356C, T366W mutations in one of the two CH3 domains and Y349C, T366S, L368A, Y407V mutations in the other of the two CH3 domains. In some embodiments, the heterodimeric molecule comprises Y349C, T366W mutations in one of the two CH3 domains and E356C, T366S, L368A, Y407V mutations in the other of the two CH3 domains. In some embodiments, the heterodimeric molecule comprises Y349C, T366W mutations in one of the two CH3 domains and S354C, T366S, L368A, Y407V mutations in the other of the two CH3 domains. Examples of other knobs-in-holes technologies are known in the art, e.g. as described by EP 1 870 459 A1.

In some embodiments, the Fc subunits of the heterodimeric molecule additionally can contain one or more other Fc mutation, such as any described above. In some embodiments, the heterodimer molecule contains an Fc subunit with a mutation that reduces effector function.

In some embodiments, an Fc variant containing CH3 protuberance/cavity modifications can be joined to a stacked immunomodulatory polypeptide anywhere, but typically via its N- or C-terminus, to the N- or C-terminus of a first and/or second stacked immunomodulatory polypeptide, such as to form a fusion polypeptide. The linkage can be direct or indirect via a linker. Typically, a knob and hole molecule is generated by co-expression of a first stacked immunomodulatory polypeptide linked to an Fc variant containing CH3 protuberance modification(s) with a second stacked immunomodulatory polypeptide linked to an Fc variant containing CH3 cavity modification(s).

C. Conjugates and Fusions of Variant Polypeptides and Immunomodulatory Proteins

In some embodiments, the variant polypeptides provided herein, which are immunomodulatory proteins comprising variants of an Ig domain of the IgSF family (vIgD), can be conjugated with or fused with a moiety, such as an effector moiety, such as another protein, directly or indirectly, to form a conjugate ("IgSF conjugate"). In some embodiments, the attachment can be covalent or non-covalent, e.g., via a biotin-streptavidin non-covalent interaction. In some embodiments of a CD80-Fc variant fusion, any one or combination of any two or more of the foregoing conjugates can be attached to the Fc or to the variant CD80 polypeptide or to both In some embodiments, the moiety can be a targeting moiety, a small molecule drug (non-polypeptide drug of less than 500 daltons molar mass), a toxin, a cytostatic agent, a cytotoxic agent, an immunosuppressive agent, a radioactive agent suitable for diagnostic purposes, a radioactive metal ion for therapeutic purposes, a prodrug-activating enzyme, an agent that increases biological half-life, or a diagnostic or detectable agent.

In some embodiments the effector moiety is a therapeutic agent, such as a cancer therapeutic agent, which is either cytotoxic, cytostatic or otherwise provides some therapeutic benefit. In some embodiments, the effector moiety is a targeting moiety or agent, such as an agent that targets a cell surface antigen, e.g., an antigen on the surface of a tumor cell. In some embodiments, the effector moiety is a label, which can generate a detectable signal, either directly or indirectly. In some embodiments, the effector moiety is a toxin. In some embodiments, the effector moiety is a protein, peptide, nucleic acid, small molecule or nanoparticle.

In some embodiments, 1, 2, 3, 4, 5 or more effector moieties, which can be the same or different, are conjugated, linked or fused to the variant polypeptide or protein to form an IgSF conjugate. In some embodiments, such effector moieties can be attached to the variant polypeptide or immunomodulatory protein using various molecular biological or chemical conjugation and linkage methods known in the art and described below. In some embodiments, linkers such as peptide linkers, cleavable linkers, non-cleavable linkers or linkers that aid in the conjugation reaction, can be used to link or conjugate the effector moieties to the variant polypeptide or immunomodulatory protein.

In some embodiments, the IgSF conjugate comprises the following components: (protein or polypeptide), $(L)_q$ and (effector moiety)$_m$, wherein the protein or polypeptide is any of the described variant polypeptides or immunomodulatory proteins capable of binding one or more cognate counter structure ligands as described; L is a linker for linking the protein or polypeptide to the moiety; m is at least 1; q is 0 or more; and the resulting IgSF conjugate binds to the one or more counter structure ligands. In particular embodiments, m is 1 to 4 and q is 0 to 8.

In some embodiments, there is provided an IgSF conjugate comprising a variant polypeptide or immunomodulatory protein provided herein conjugated with a targeting agent that binds to a cell surface molecule, for example, for targeted delivery of the variant polypeptide or immunomodulatory protein to a specific cell. In some embodiments, the targeting agent is a molecule(s) that has the ability to localize and bind to a molecule present on a normal cell/tissue and/or tumor cell/tumor in a subject. In other words, IgSF conjugates comprising a targeting agent can bind to a ligand (directly or indirectly), which is present on a cell, such as a tumor cell. The targeting agents of the invention contemplated for use include antibodies, polypeptides, peptides, aptamers, other ligands, or any combination thereof, that can bind a component of a target cell or molecule.

In some embodiments, the targeting agent binds a tumor cell(s) or can bind in the vicinity of a tumor cell(s) (e.g., tumor vasculature or tumor microenvironment) following administration to the subject. The targeting agent may bind to a receptor or ligand on the surface of the cancer cell. In another aspect of the invention, a targeting agent is selected which is specific for a noncancerous cells or tissue. For example, a targeting agent can be specific for a molecule present normally on a particular cell or tissue. Furthermore, in some embodiments, the same molecule can be present on normal and cancer cells. Various cellular components and molecules are known. For example, if a targeting agent is specific for EGFR, the resulting IgSF conjugate can target cancer cells expressing EGFR as well as normal skin epidermal cells expressing EGFR. Therefore, in some embodiments, an IgSF conjugate of the invention can operate by two separate mechanisms (targeting cancer and non-cancer cells).

In various aspects of the invention disclosed herein an IgSF conjugate of the invention comprises a targeting agent which can bind/target a cellular component, such as a tumor antigen, a bacterial antigen, a viral antigen, a mycoplasm antigen, a fungal antigen, a prion antigen, an antigen from a parasite. In some aspects, a cellular component, antigen or molecule can each be used to mean, a desired target for a targeting agent. For example, in various embodiments, a targeting agent is specific for or binds to a component, which includes but is not limited to, epidermal growth factor receptor (EGFR, ErbB-1, HER1), ErbB-2 (HER2/neu), ErbB-3/HER3, ErbB-4/HER4, EGFR ligand family; insulin-like growth factor receptor (IGFR) family, IGF-binding proteins (IGFBPs), IGFR ligand family; platelet derived growth factor receptor (PDGFR) family, PDGFR ligand family; fibroblast growth factor receptor (FGFR) family, FGFR ligand family, vascular endothelial growth factor receptor (VEGFR) family, VEGF family; HGF receptor family; TRK receptor family; ephrin (EPH) receptor family; AXL receptor family; leukocyte tyrosine kinase (LTK) receptor family; TIE receptor family, angiopoietin 1,2; receptor tyrosine kinase-like orphan receptor (ROR) receptor family, e.g. ROR1; CD171 (L1CAM); B7-H6 (NCR3LG1); PD-L1, tumor glycosylation antigen, e.g. sTn or Tn, such as sTn Ag of MUC1; LHR (LHCGR); phosphatidylserine, discoidin domain receptor (DDR) family; RET receptor family; KLG receptor family; RYK receptor family; MuSK receptor family; Transfonning growth factor-α (TGF-α) receptors, TGF-β; Cytokine receptors, Class I (hematopoietin family) and Class II (interferon/IL-10 family) receptors, tumor necrosis factor (TNF) receptor superfamily (TNFRSF), death receptor family; cancer-testis (CT) antigens, lineage-specific antigens, differentiation antigens, alpha-actinin-4, ARTC1, breakpoint cluster region-Abelson (Bcr-abl) fusion products, B-RAF, caspase-5 (CASP-5), caspase-8 (CASP-8), β-catenin (CTNNB1), cell division cycle 27 (CDC27), cyclin-dependent kinase 4 (CDK4), CDKN2A, COA-I, dek-can fusion protein, EFTUD-2, Elongation factor 2 (ELF2), Ets variant gene 6/acute myeloid leukemia 1 gene ETS (ETC6-AML1) fusion protein, fibronectin (FN), e.g. the extradomain A (EDA) of fibronectin, GPNMB, low density lipid receptor/GDP-L fucose: β-Dgalactose 2-α-Lfucosyltransferase (LDLR/FUT) fusion protein, HLA-A2. arginine to isoleucine exchange at residue 170 of the α-helix of the α2-domain in the HLA-A2gene (HLA-A*201-R170I), HLA-Al 1, heat shock protein 70-2 mutated (HSP70-2M), K1AA0205, MART2, melanoma ubiquitous mutated 1, 2, 3 (MUM-I, 2, 3), prostatic acid phosphatase (PAP), neo-PAP, Myosin class I, NFYC, OGT, OS-9, pml-RARalpha fusion protein, PRDX5, PTPRK, K-ras (KRAS2), N-ras (NRAS), HRAS, RBAF600, SIRT2, SNRPD1, SYT-SSX1 or -SSX2 fusion protein, Triosephosphate Isomerase, BAGE, BAGK-1, BAGE-2,3,4,5, GAGE-1,2,3,4,5,6,7,8, GnT-V (aberrant N-acetyl glucosaminyl transferase V, MGAT5), HERV-K-MEL, KK-LC, KM-HN-I, LAGE, LAGE-I, CTL-recognized antigen on melanoma (CAMEL), MAGE-A1 (MAGE-I), MAGE-A2, MAGE-A3, MAGE-A4, MAGE-A5, MAGE-A6, MAGE-A8, MAGE-A9, MAGE-AlO, MAGE-AI 1, MAGE-A12, MAGE-3, MAGE-B1, MAGE-B2, MAGE-B5, MAGE-B6, MAGE-Cl, MAGE-C2, mucin 1 (MUC1), MART-1/Melan-A (MLANA), gplOO, gplOO/Pmell7 (SILV), tyrosinase (TYR), TRP-I, HAGE, NA-88, NY-ESO-I, NY-ESO-1/LAGE-2, SAGE, Spl7, SSX-1,2,3,4, TRP2-INT2, carcinoembryonic antigen (CEA), Kallikrein 4, mammaglobin-A, OA1, prostate specific antigen (PSA), TRP-1/gp75, TRP-2, adipophilin, interferon inducible protein absent in melanoma 2 (AIM-2), BING-4, CPSF, cyclin Dl, epithelial cell adhesion molecule (Ep-CAM), EphA3, fibroblast growth factor-5 (FGF-5), glycoprotein 250 (gp250), EGFR (ERBB1), HER-2/neu (ERBB2), interleukin 13 receptor α2 chain (IL13Rα2), IL-6 receptor, intestinal carboxyl esterase (iCE), alpha-feto protein (AFP), M-CSF, mdm-2, MUC1, p53 (TP53), PBF, PRAME, PSMA, RAGE-I, RNF43, RU2AS, SOX10, STEAP1, survivin (BIRC5), human telomerase reverse transcriptase (hTERT), telomerase, Wilms' tumor gene (WT1), SYCP1, BRDT, SPANX, XAGE, ADAM2, PAGE-5, LIP1, CTAGE-I, CSAGE, MMA1, CAGE, BORIS, HOM-TES-85, AF15ql4, HCA661, LDHC, MORC, SGY-I, SPOl1, TPX1, NY-SAR-35, FTHL17, NXF2, TDRD1, TEX15, FATE, TPTE, immunoglobulin idiotypes, Bence-Jones protein, estrogen receptors (ER), androgen receptors (AR), CD40, CD30, CD20, CD 19, CD33, cancer antigen 72-4 (CA 72-4), cancer antigen 15-3 (CA 15-3), cancer antigen 27-29 (CA 27-29), cancer antigen 125 (CA 125), cancer antigen 19-9 (CA 19-9), β-human chorionic gonadotropin, β-2 microglobulin, squamous cell carcinoma antigen, neuron-specific enolase, heat shock protein gp96, GM2, sargramostim, CTLA-4, 707 alanine proline (707-AP), adenocarcinoma antigen recognized by T cells 4 (ART-4), carcinoembryogenic antigen peptide-1 (CAP-I), calcium-activated chloride channel-2 (CLCA2), cyclophilin B (Cyp-B), human signet ring tumor-2 (HST-2), Human papilloma virus (HPV) proteins (HPV-E6, HPV-E7, major or minor capsid antigens, others), Epstein-Barr virus (EBV) proteins (EBV latent membrane proteins—LMP1, LMP2; others), Hepatitis B or C virus proteins, and HIV proteins.

In some embodiments, an IgSF conjugate, through its targeting agent, will bind a cellular component of a tumor cell, tumor vasculature or tumor microenvironment, thereby promoting killing of targeted cells via modulation of the immune response, (e.g., by activation of co-stimulatory molecules or inhibition of negative regulatory molecules of immune cell activation), inhibition of survival signals (e.g., growth factor or cytokine or hormone receptor antagonists), activation of death signals, and/or immune-mediated cytotoxicity, such as through antibody dependent cellular cytotoxicity. Such IgSF conjugates can function through several mechanisms to prevent, reduce or eliminate tumor cells, such as to facilitate delivery of conjugated effector moieties to the tumor target, such as through receptor-mediated endocytosis of the IgSF conjugate; or such conjugates can recruit, bind, and/or activate immune cells (e.g. NK cells, monocytes/macrophages, dendritic cells, T cells, B cells). Moreover, in some instances one or more of the foregoing pathways may operate upon administration of one or more IgSF conjugates of the invention.

In some embodiments, an IgSF conjugate, through its targeting agent, will be localized to, such as bind to, a cellular component of a tumor cell, tumor vasculature or tumor microenvironment, thereby modulating cells of the immune response in the vicinity of the tumor. In some embodiments, the targeting agent facilitates delivery of the conjugated IgSF (e.g. vIgD) to the tumor target, such as to interact with its cognate binding partner to alter signaling of immune cells (e.g. NK cells, monocytes/macrophages, dendritic cells, T cells, B cells) bearing the cognate binding partner. In some embodiments, localized delivery mediates costimulatory signaling via CD28 or ICOS.

In some embodiments, the targeting agent is an immunoglobulin. As used herein, the term "immunoglobulin" includes natural or artificial mono- or polyvalent antibodies including, but not limited to, polyclonal, monoclonal, multispecific, human, humanized or chimeric antibodies, single chain antibodies, Fab fragments, F(ab') fragments, fragments produced by a Fab expression library, signle chain Fv (scFv); anti-idiotypic (anti-Id) antibodies (including, e.g., anti-Id antibodies to antibodies of the invention), and epitope-binding fragments of any of the above. The term "antibody," as used herein, refers to immunoglobulin molecules and immunologically active portions of immunoglobulin molecules, e.g., molecules that contain an antigen binding site that immunospecifically binds an antigen. The immunoglobulin molecules of the invention can be of any type (e.g., IgG, IgE, IgM, IgD, IgA, and IgY), class (e.g., IgG1, IgG2, IgG3, IgG4, IgA1, and IgA2) or subclass of immunoglobulin molecule.

In some embodiments, an IgSF conjugate, through its antibody targeting moiety, will bind a cellular component of a tumor cell, tumor vasculature or tumor microenvironment, thereby promoting apoptosis of targeted cells via modulation of the immune response, (e.g., by activation of co-stimulatory molecules or inhibition of negative regulatory molecules of immune cell activation), inhibition of survival signals (e.g., growth factor or cytokine or hormone receptor antagonists), activation of death signals, and/or immune-mediated cytotoxicity, such as through antibody dependent cellular cytotoxicity. Such IgSF conjugates can function through several mechanisms to prevent, reduce or eliminate tumor cells, such as to facilitate delivery of conjugated effector moieties to the tumor target, such as through receptor-mediated endocytosis of the IgSF conjugate; or such conjugates can recruit, bind, and/or activate immune cells (e.g. NK cells, monocytes/macrophages, dendritic cells, T cells, B cells).

In some embodiments, an IgSF conjugate, through its antibody targeting moiety, will bind a cellular component of a tumor cell, tumor vasculature or tumor microenvironment, thereby modulating the immune response (e.g., by activation of co-stimulatory molecules or inhibition of negative regulatory molecules of immune cell activation). In some embodiments, such conjugates can recognize, bind, and/or modulate (e.g. inhibit or activate) immune cells (e.g. NK cells, monocytes/macrophages, dendritic cells, T cells, B cells).

Antibody targeting moieties of the invention include antibody fragments that include, but are not limited to, Fab, Fab' and F(ab')2, Fd, single-chain Fvs (scFv), single-chain antibodies, disulfide-linked Fvs (sdFv) and fragments comprising either a VL or VH domain. Antigen-binding antibody fragments, including single-chain antibodies, may comprise the variable region(s) alone or in combination with the entirety or a portion of the following: hinge region, CH1, CH2, and CH3 domains. Also included in the invention are antigen-binding fragments also comprising any combination of variable region(s) with a hinge region, CH1, CH2, and CH3 domains. Also included in the invention are Fc fragments, antigen-Fc fusion proteins, and Fc-targeting moiety conjugates or fusion products (Fc-peptide, Fc-aptamer). The antibody targeting moieties of the invention may be from any animal origin including birds and mammals. In one aspect, the antibody targeting moieties are human, murine (e.g., mouse and rat), donkey, sheep, rabbit, goat, guinea pig, camel, horse, or chicken. Further, such antibodies may be humanized versions of animal antibodies. The antibody targeting moieties of the invention may be monospecific, bispecific, trispecific, or of greater multispecificity.

In various embodiments, an antibody/targeting moiety recruits, binds, and/or activates immune cells (e.g. NK cells, monocytes/macrophages, dendritic cells) via interactions between Fc (in antibodies) and Fc receptors (on immune cells) and via the conjugated variant polypeptides or immunomodulatory proteins provided herein. In some embodiments, an antibody/targeting moiety recognizes or binds a tumor agent via and localizes to the tumor cell the conjugated variant polypeptides or immunomodulatory proteins provided herein to facilitate modulation of immune cells in the vicinity of the tumor.

Examples of antibodies which can be incorporated into IgSF conjugates include but are not limited to antibodies such as Cetuximab (IMC-C225; Erbitux®), Trastuzumab (Herceptin®), Rituximab (Rituxan®; MabThera®), Bevacizumab (Avastin®), Alemtuzumab (Campath®; Campath-1H®; Mabcampath®), Panitumumab (ABX-EGF; Vectibix®), Ranibizumab (Lucentis®), Ibritumomab, Ibritumomab tiuxetan, (Zevalin®), Tositumomab, Iodine I 131 Tositumomab (BEXXAR®), Catumaxomab (Removab®), Gemtuzumab, Gemtuzumab ozogamicine (Mylotarg®), Abatacept (CTLA-4-Ig; Orencia®), Belatacept (L104EA29YIg; LEA29Y; LEA), Ipilimumab (MDX-010; MDX-101), Tremelimumab (ticilimumab; CP-675,206), PRS-010, PRS-050, Aflibercept (VEGF Trap, AVE005), Volociximab (M200), F200, MORAb-009, SS1P (CAT-5001), Cixutumumab (IMC-A12), Matuzumab (EMD72000), Nimotuzumab (h-R3), Zalutumumab (HuMax-EGFR), Necitumumab IMC-11F8, mAb806/ch806, Sym004, mAb-425, Panorex @ (17-1A) (murine monoclonal antibody); Panorex @ (17-1A) (chimeric murine monoclonal antibody); IDEC-Y2B8 (murine, anti-CD20 MAb); BEC2 (anti-idiotypic MAb, mimics the GD epitope) (with BCG); Oncolym (Lym-1 monoclonal antibody); SMART MI95 Ab, humanized 13' I LYM-I (Oncolym), Ovarex (B43.13, anti-idiotypic mouse MAb); MDX-210 (humanized anti-HER-2 bispecific antibody); 3622W94 MAb that binds to EGP40 (17-1A) pancarcinoma antigen on adenocarcinomas; Anti-VEGF, Zenapax (SMART Anti-Tac (IL-2 receptor); SMART MI95 Ab, humanized Ab, humanized); MDX-210 (humanized anti-HER-2 bispecific antibody); MDX-447 (humanized anti-EGF receptor bispecific antibody); NovoMAb-G2 (pancarcinoma specific Ab); TNT (chimeric MAb to histone antigens); TNT (chimeric MAb to histone antigens); Gliomab-H (Monoclon s—Humanized Abs); GNI-250 Mab; EMD-72000 (chimeric-EGF antagonist); LymphoCide (humanized LL2 antibody); and MDX-260 bispecific, targets GD-2, ANA Ab, SMART IDlO Ab, SMART ABL 364 Ab or ImmuRAIT-CEA. As illustrated by the forgoing list, it is conventional to make antibodies to a particular target epitope.

In some embodiments, the antibody targeting moiety is a full length antibody, or antigen-binding fragment thereof, containing an Fc domain. In some embodiments, the variant polypeptide or immunomodulatory protein is conjugated to the Fc portion of the antibody targeting moiety, such as by conjugation to the N-terminus of the Fc portion of the antibody.

Figures 6A, 6B:
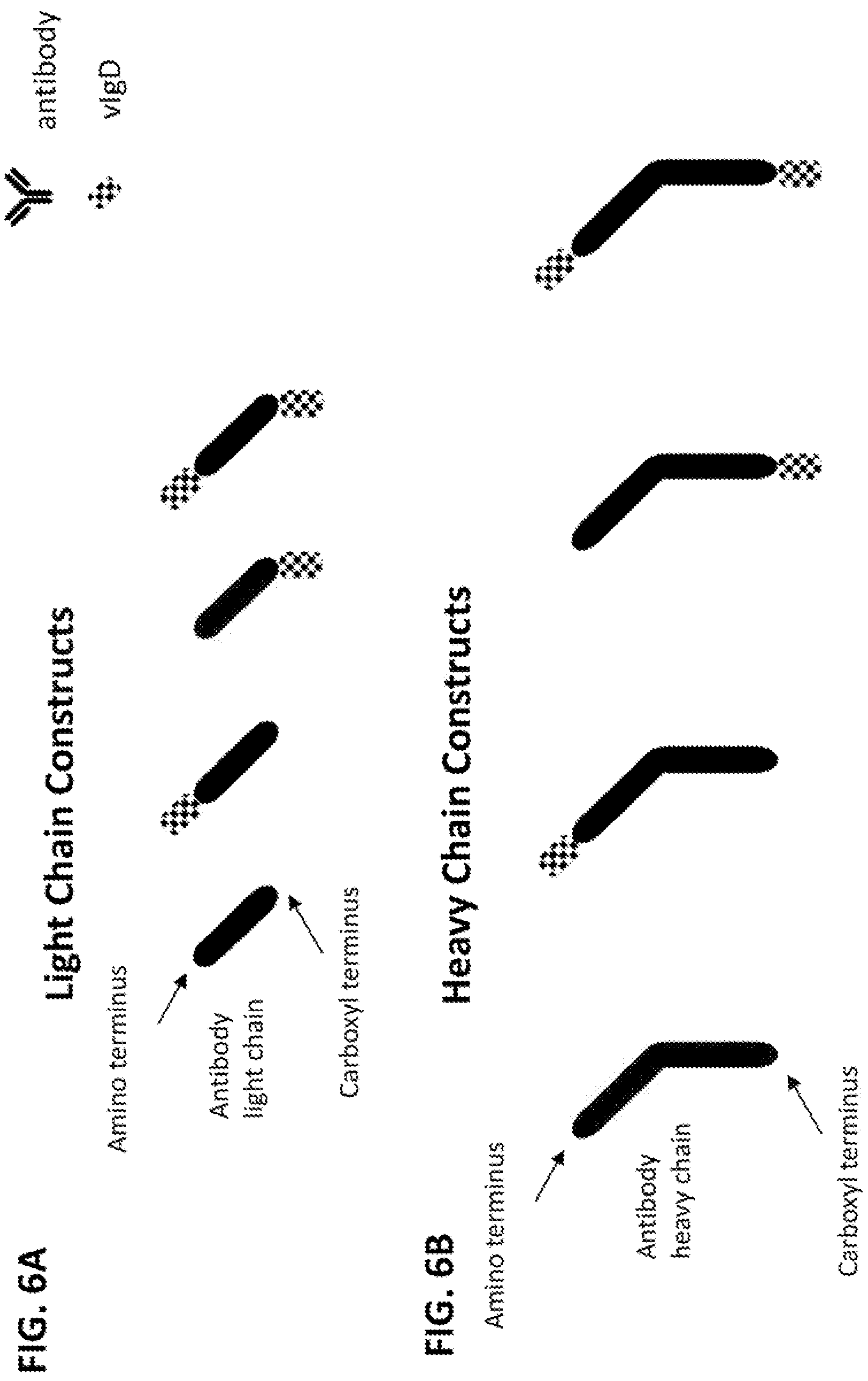
FIG. 6A-6C depicts various exemplary configurations of a variant IgSF domain (vIgD) conjugated to an antibody (V-Mab).
Figure 6C:
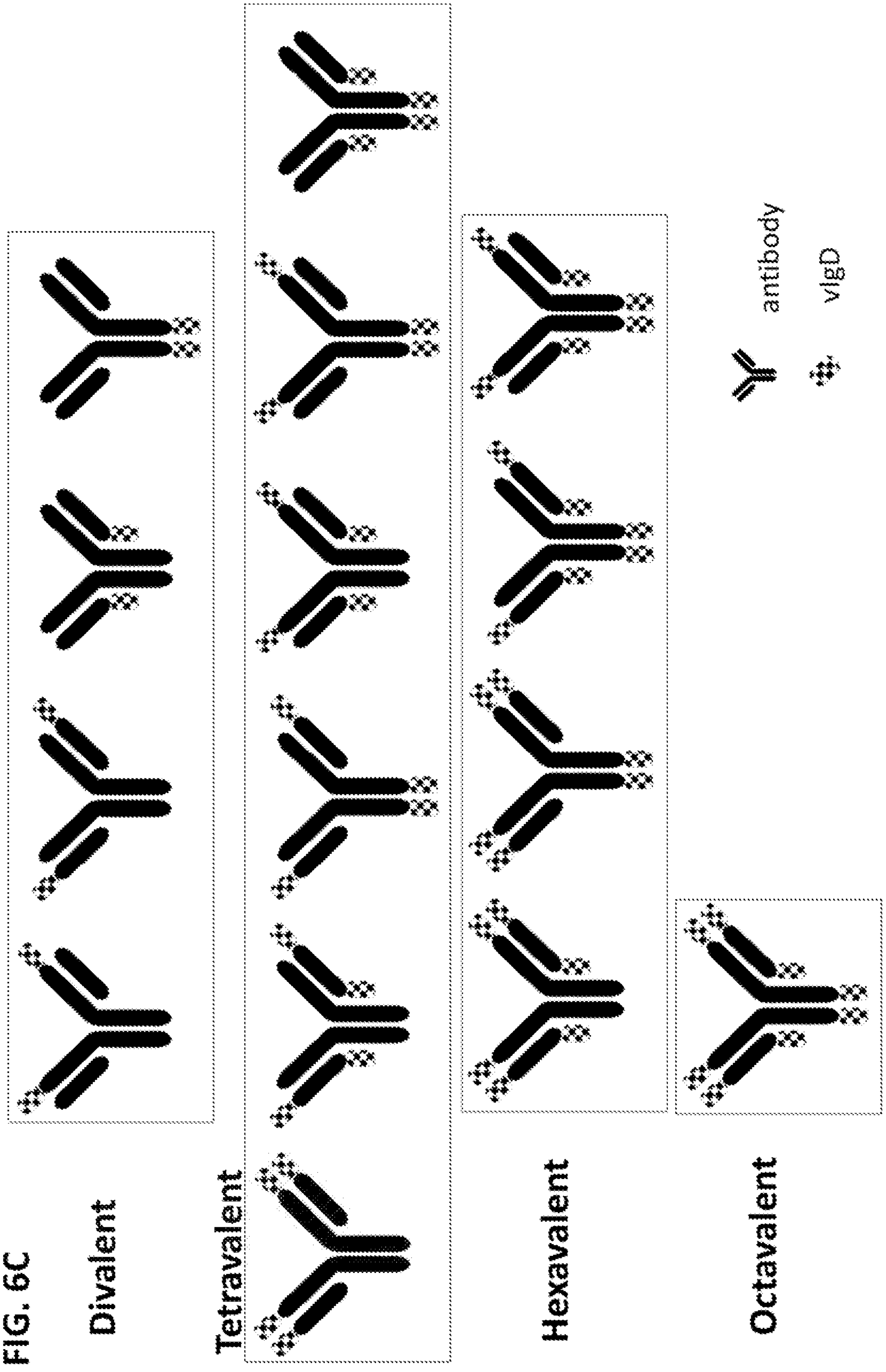

In some embodiments, the vIgD is linked, directly or indirectly, to the N- or C-terminus of the light and/or heavy chain of the antibody. In some embodiments, linkage can be via a peptide linker, such as any described above. Various configurations can be constructed. FIG. 6A-6C depict exemplary configurations. In some embodiments, the antibody conjugate can be produced by co-expression of the heavy and light chain of the antibody in a cell.

In one aspect of the invention, the targeting agent is an aptamer molecule. For example, in some embodiments, the aptamer is comprised of nucleic acids that function as a targeting agent. In various embodiments, an IgSF conjugate of the invention comprises an aptamer that is specific for a molecule on a tumor cell, tumor vasculature, and/or a tumor microenvironment. In some embodiments, the aptamer itself can comprise a biologically active sequence, in addition to the targeting module (sequence), wherein the biologically active sequence can induce an immune response to the target cell. In other words, such an aptamer molecule is a dual use agent. In some embodiments, an IgSF conjugate of the invention comprises conjugation of an aptamer to an antibody, wherein the aptamer and the antibody are specific for binding to separate molecules on a tumor cell, tumor vasculature, tumor microenvironment, and/or immune cells.

The term "aptamer" includes DNA, RNA or peptides that are selected based on specific binding properties to a particular molecule. For example, an aptamer(s) can be selected for binding a particular gene or gene product in a tumor cell, tumor vasculature, tumor microenvironment, and/or an immune cell, as disclosed herein, where selection is made by methods known in the art and familiar to one of skill in the art.

In some aspects of the invention the targeting agent is a peptide. For example, the variant polypeptides or immunomodulatory proteins provided herein can be conjugated to a peptide which can bind with a component of a cancer or tumor cells. Therefore, such IgSF conjugates of the invention comprise peptide targeting agents which binds to a cellular component of a tumor cell, tumor vasculature, and/or a component of a tumor microenvironment. In some embodiments, targeting agent peptides can be an antagonist or agonist of an integrin. Integrins, which comprise an alpha and a beta subunit, include numerous types well known to a skilled artisan.

In one embodiment, the targeting agent is Vv33. Integrin Vv33 is expressed on a variety of cells and has been shown to mediate several biologically relevant processes, including adhesion of osteoclasts to bone matrix, migration of vascular smooth muscle cells, and angiogenesis. Suitable targeting molecules for integrins include RGD peptides or peptidomimetics as well as non-RGD peptides or peptidomimetics (see, e.g., U.S. Pat. Nos. 5,767,071 and 5,780,426) for other integrins such as V4.βi (VLA-4), V4-P7 (see, e.g., U.S. Pat. No. 6,365,619; Chang et al, Bioorganic & Medicinal Chem Lett, 12:159-163 (2002); Lin et al., Bioorganic & Medicinal Chem Lett, 12:133-136 (2002)), and the like.

In some embodiments, there is provided an IgSF conjugate comprising a variant polypeptide or immunomodulatory protein provided herein conjugated with a therapeutic agent. In some embodiments, the therapeutic agent includes, for example, daunomycin, doxorubicin, methotrexate, and vindesine (Rowland et al., Cancer Immunol. Immunother. 21:183-187, 1986). In some embodiments, the therapeutic agent has an intracellular activity. In some embodiments, the IgSF conjugate is internalized and the therapeutic agent is a cytotoxin that blocks the protein synthesis of the cell, therein leading to cell death. In some embodiments, the therapeutic agent is a cytotoxin comprising a polypeptide having ribosome-inactivating activity including, for example, gelonin, bouganin, saporin, ricin, ricin A chain, bryodin, diphtheria toxin, restrictocin, *Pseudomonas* exotoxin A and variants thereof. In some embodiments, where the therapeutic agent is a cytotoxin comprising a polypeptide having a ribosome-inactivating activity, the IgSF conjugate must be internalized upon binding to the target cell in order for the protein to be cytotoxic to the cells.

In some embodiments, there is provided an IgSF conjugate comprising a variant polypeptide or immunomodulatory protein provided herein conjugated with a toxin. In some embodiments, the toxin includes, for example, bacterial toxins such as diphtheria toxin, plant toxins such as ricin, small molecule toxins such as geldanamycin (Mandler et al., J. Nat. Cancer Inst. 92(19):1573-1581 (2000); Mandler et al., Bioorganic & Med. Chem. Letters 10: 1025-1028 (2000); Mandler et al., Bioconjugate Chem. 13:786-791 (2002)), maytansinoids (EP 1391213; Liu et al., Proc. Natl. Acad. Sci. USA 93:8618-8623 (1996)), and calicheamicin (Lode et al., Cancer Res. 58:2928 (1998); Hinman et al., Cancer Res. 53:3336-3342 (1993)). The toxins may exert their cytotoxic and cytostatic effects by mechanisms including tubulin binding, DNA binding, or topoisomerase inhibition.

In some embodiments, there is provided an IgSF conjugate comprising a variant polypeptide or immunomodulatory protein provided herein conjugated with a label, which can generate a detectable signal, indirectly or directly. These IgSF conjugates can be used for research or diagnostic applications, such as for the in vivo detection of cancer. The label is preferably capable of producing, either directly or indirectly, a detectable signal. For example, the label may be radio-opaque or a radioisotope, such as 3H, 14C, 32P, 35S, 123I, 125I, 131I; a fluorescent (fluorophore) or chemiluminescent (chromophore) compound, such as fluorescein isothiocyanate, rhodamine or luciferin; an enzyme, such as alkaline phosphatase, β-galactosidase or horseradish peroxidase; an imaging agent; or a metal ion. In some embodiments, the label is a radioactive atom for scintigraphic studies, for example 99Tc or 123I, or a spin label for nuclear magnetic resonance (NMR) imaging (also known as magnetic resonance imaging, MRI), such as zirconium-89, iodine-123, iodine-131, indium-111, fluorine-19, carbon-13, nitrogen-15, oxygen-17, gadolinium, manganese or iron. Zirconium-89 may be complexed to various metal chelating agents and conjugated to antibodies, e.g., for PET imaging (WO 2011/056983). In some embodiments, the IgSF conjugate is detectable indirectly. For example, a secondary antibody that is specific for the IgSF conjugate and contains a detectable label can be used to detect the IgSF conjugate.

The IgSF conjugates may be prepared using any methods known in the art. See, e.g., WO 2009/067800, WO 2011/133886, and U.S. Patent Application Publication No. 2014322129, incorporated by reference herein in their entirety.

The variant polypeptides or immunomodulatory proteins of an IgSF conjugate may be "attached to" the effector moiety by any means by which the variant polypeptides or immunomodulatory proteins can be associated with, or linked to, the effector moiety. For example, the variant polypeptides or immunomodulatory proteins of an IgSF conjugate may be attached to the effector moiety by chemical or recombinant means. Chemical means for preparing fusions or conjugates are known in the art and can be used to prepare the IgSF conjugate. The method used to conjugate the variant polypeptides or immunomodulatory proteins and effector moiety must be capable of joining the variant polypeptides or immunomodulatory proteins with the effector moiety without interfering with the ability of the variant polypeptides or immunomodulatory proteins to bind to their one or more counter structure ligands.

The variant polypeptides or immunomodulatory proteins of an IgSF conjugate may be linked indirectly to the effector moiety. For example, the variant polypeptides or immunomodulatory proteins of an IgSF conjugate may be directly linked to a liposome containing the effector moiety of one of several types. The effector moiety(s) and/or the variant polypeptides or immunomodulatory proteins may also be bound to a solid surface.

In some embodiments, the variant polypeptides or immunomodulatory proteins of an IgSF conjugate and the effector moiety are both proteins and can be conjugated using techniques well known in the art. There are several hundred crosslinkers available that can conjugate two proteins. (See for example "Chemistry of Protein Conjugation and Crosslinking," 1991, Shans Wong, CRC Press, Ann Arbor). The crosslinker is generally chosen based on the reactive functional groups available or inserted on the variant polypeptides or immunomodulatory proteins and/or effector moiety. In addition, if there are no reactive groups, a photoactivatible crosslinker can be used. In certain instances, it may be desirable to include a spacer between the variant polypeptides or immunomodulatory proteins and the effector moiety. Crosslinking agents known to the art include the homobifunctional agents: glutaraldehyde, dimethyladipimidate and Bis(diazobenzidine) and the heterobifunctional agents: m Maleimidobenzoyl-N-Hydroxysuccinimide and Sulfo-m Maleimidobenzoyl-N-Hydroxysuccinimide.

In some embodiments, the variant polypeptides or immunomodulatory proteins of an IgSF conjugate may be engineered with specific residues for chemical attachment of the effector moiety. Specific residues used for chemical attachment of molecule known to the art include lysine and cysteine. The crosslinker is chosen based on the reactive functional groups inserted on the variant polypeptides or immunomodulatory proteins, and available on the effector moiety.

An IgSF conjugate may also be prepared using recombinant DNA techniques. In such a case a DNA sequence encoding the variant polypeptides or immunomodulatory proteins is fused to a DNA sequence encoding the effector moiety, resulting in a chimeric DNA molecule. The chimeric DNA sequence is transfected into a host cell that expresses the fusion protein. The fusion protein can be recovered from the cell culture and purified using techniques known in the art.

Examples of attaching an effector moiety, which is a label, to the variant polypeptides or immunomodulatory proteins include the methods described in Hunter, et al., Nature 144:945 (1962); David, et al., Biochemistry 13:1014 (1974); Pain, et al., J. Immunol. Meth. 40:219 (1981); Nygren, J. Histochem. and Cytochem. 30:407 (1982); Wensel and Meares, Radioimmunoimaging And Radioimmunotherapy, Elsevier, N.Y. (1983); and Colcher et al., "Use Of Monoclonal Antibodies As Radiopharmaceuticals For The Localization Of Human Carcinoma Xenografts In Athymic Mice", Meth. Enzymol., 121:802-16 (1986).

The radio- or other labels may be incorporated in the conjugate in known ways. For example, the peptide may be biosynthesized or may be synthesized by chemical amino acid synthesis using suitable amino acid precursors involving, for example, fluorine-19 in place of hydrogen. Labels such as 99Tc or 1231, 186Re, 188Re and 111In can be attached via a cysteine residue in the peptide. Yttrium-90 can be attached via a lysine residue. The IODOGEN method (Fraker et al., Biochem. Biophys. Res. Commun. 80:49-57 (1978)) can be used to incorporate iodine-123. "Monoclonal Antibodies in Immunoscintigraphy" (Chatal, CRC Press 1989) describes other methods in detail.

Conjugates of the variant polypeptides or immunomodulatory proteins and a cytotoxic agent may be made using a variety of bifunctional protein coupling agents such as N-succinimidyl-3-(2-pyridyldithio) propionate (SPDP), succinimidyl-4-(N-maleimidomethyl) cyclohexane-1-carboxylate (SMCC), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). For example, a ricin immunotoxin can be prepared as described in Vitetta et al., Science 238:1098 (1987). Carbon-14-labeled 1-isothiocyanatobenzyl-3-methyldiethylene tnaminepentaacetic acid (MX-DTPA) is an exemplary chelating agent for conjugation of radionucleotide to the antibody. See, e.g., WO94/11026. The linker may be a "cleavable linker" facilitating release of the cytotoxic drug in the cell. For example, an acid-labile linker, peptidase-sensitive linker, photolabile linker, dimethyl linker or disulfide-containing linker (Chari et al., Cancer Research 52:127-131 (1992); U.S. Pat. No. 5,208,020) may be used.

The IgSF conjugates of the invention expressly contemplate, but are not limited to, drug conjugates prepared with cross-linker reagents: BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfone)benzoate) which are commercially available (e.g., from Pierce Biotechnology, Inc., Rockford, Ill., U.S.A). See pages 467-498, 2003-2004 Applications Handbook and Catalog.

D. Transmembrane and Secretable Immunomodulatory Proteins and Engineered Cells

Provided herein are engineered cells which express the immunomodulatory variant CD80 polypeptides (alternatively, "engineered cells"). In some embodiments, the expressed immunomodulatory variant CD80 polypeptide is a transmembrane proteins and is surface expressed. In some embodiments, the expressed immunomodulatory variant CD80 polypeptide is expressed and secreted from the cell.

1. Transmembrane Immunomodulatory Proteins

In some embodiments, an immunomodulatory polypeptide comprising a variant CD80 can be a membrane bound protein. As described in more detail below, the immunomodulatory polypeptide can be a transmembrane immunomodulatory polypeptide comprising a variant CD80 in which is contained: an ectodomain containing at least one affinity modified IgSF domain (IgV or IgC), a transmembrane domain and, optionally, a cytoplasmic domain. In some embodiments, the transmembrane immunomodulatory protein can be expressed on the surface of an immune cell, such as a mammalian cell, including on the surface of a lymphocyte (e.g. T cell or NK cell) or antigen presenting cell. In some embodiments, the transmembrane immunomodulatory protein is expressed on the surface of a mammalian T-cell, including such T-cells as: a T helper cell, a cytotoxic T-cell (alternatively, cytotoxic T lymphocyte or CTL), a natural killer T-cell, a regulatory T-cell, a memory T-cell, or a gamma delta T-cell. In some embodiments, the mammalian cell is an antigen presenting cell (APC). Typically, but not exclusively, the ectodomain (alternatively, "extracellular domain") of comprises the one or more amino acid variations (e.g. amino acid substitutions) of the variant CD80 of the invention. Thus, for example, in some embodiments a transmembrane protein will comprise an ectodomain that comprises one or more amino acid substitutions of a variant CD80 of the invention.

In some embodiments, the engineered cells express a variant CD80 polypeptides are transmembrane immunomodulatory polypeptides (TIPs) that can be a membrane protein such as a transmembrane protein. In typical embodiments, the ectodomain of a membrane protein comprises an extracellular domain or IgSF domain thereof of a variant CD80 provided herein in which is contained one or more amino acid substitutions in at least one IgSF domain as described. The transmembrane immunomodulatory proteins provided herein further contain a transmembrane domain linked to the ectodomain. In some embodiments, the transmembrane domain results in an encoded protein for cell surface expression on a cell. In some embodiments, the transmembrane domain is linked directly to the ectodomain. In some embodiments, the transmembrane domain is linked indirectly to the ectodomain via one or more linkers or spacers. In some embodiments, the transmembrane domain contains predominantly hydrophobic amino acid residues, such as leucine and valine.

In some embodiments, a full length transmembrane anchor domain can be used to ensure that the TIPs will be expressed on the surface of the engineered cell, such as engineered T cell. Conveniently, this could be from a particular native protein that is being affinity modified (e.g. CD80 or other native IgSF protein), and simply fused to the sequence of the first membrane proximal domain in a similar fashion as the native IgSF protein (e.g. CD80). In some embodiments, the transmembrane immunomodulatory protein comprises a transmembrane domain of the corresponding wild-type or unmodified IgSF member, such as a transmembrane domain contained in the sequence of amino acids set forth in SEQ ID NO: 1 (Table 2). In some embodiments, the membrane bound form comprises a transmembrane domain of the corresponding wild-type or unmodified polypeptide, such as corresponding to residues 243-263 of SEQ ID NO:1.

In some embodiments, the transmembrane domain is a non-native transmembrane domain that is not the transmembrane domain of native CD80. In some embodiments, the transmembrane domain is derived from a transmembrane domain from another non-CD80 family member polypeptide that is a membrane-bound or is a transmembrane protein. In some embodiments, a transmembrane anchor domain from another protein on T cells can be used. In some embodiments, the transmembrane domain is derived from CD8. In some embodiments, the transmembrane domain can further contain an extracellular portion of CD8 that serves as a spacer domain. An exemplary CD8 derived transmembrane domain is set forth in SEQ ID NO: 246 or 399 or a portion thereof containing the CD8 transmembrane domain. In some embodiments, the transmembrane domain is a synthetic transmembrane domain.

In some embodiments, the transmembrane immunomodulatory protein further contains an endodomain, such as a cytoplasmic signaling domain, linked to the transmembrane domain. In some embodiments, the cytoplasmic signaling domain induces cell signaling. In some embodiments, the endodomain of the transmembrane immunomodulatory protein comprises the cytoplasmic domain of the corresponding wild-type or unmodified polypeptide, such as a cytoplasmic domain contained in the sequence of amino acids set forth in SEQ ID NO:1 (see Table 2).

In some embodiments, a provided transmembrane immunomodulatory protein that is or comprises a variant CD80 comprises a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 253 and contains an ectodomain comprising at least one affinity-modified CD80 IgSF domain as described and a transmembrane domain. In some embodiments, the transmembrane immunomodulatory protein contains any one or more amino acid substitutions in an IgSF domain (e.g. IgV domain) as described, including any set forth in Table 1. In some embodiments, the transmembrane immunomodulatory protein can further comprise a cytoplasmic domain as described. In some embodiments, the transmembrane immunomodulatory protein can further contain a signal peptide. In some embodiments, the signal peptide is the native signal peptide of wild-type IgSF member, such as contained in the sequence of amino acids set forth in SEQ ID NO: 1 (see e.g. Table 2).

Also provided is a nucleic acid molecule encoding such transmembrane immunomodulatory proteins. In some embodiments, a nucleic acid molecule encoding a transmembrane immunomodulatory protein comprises a nucleotide sequence that encodes a sequence of amino acids that exhibits at least 85%, 86%, 87%, 88%, 89%, 90%, 91%, 92%, 93%, 94%, 95%, 96%, 97%, 98% or 99% sequence identity to SEQ ID NOS: 253 and contains an ectodomain comprising at least one affinity-modified IgSF domain as described, a transmembrane domain and, optionally, a cytoplasmic domain. In some embodiments, the nucleic acid molecule can further comprise a sequence of nucleotides encoding a signal peptide. In some embodiments, the signal peptide is the native signal peptide of the corresponding wild-type IgSF member (see e.g. Table 2).

An example of a transmembrane immunomodulatory protein is a CD80 TIP comprising i) the sequence of amino acids set forth in SEQ ID NO:241 or ii) a sequence of amino acids that exhibits at least 85%, 86%, 87%, 88%, 89%, 90%, 91%, 92%, 93%, 94%, 95%, 96%, 97%, 98% or 99% sequence identity to SEQ ID NO:241 and that comprises the affinity-modified domain of SEQ ID NO:241 or the amino acid substitutions contained therein. Also provided is i) a sequence of nucleotides set forth in SEQ ID NO:242, ii) a sequence that exhibits at least 85%, 86%, 87%, 88%, 89%, 90%, 91%, 92%, 93%, 94%, 95%, 96%, 97%, 98% or 99% sequence identity to SEQ ID NO: 242 and that encodes a TIP that comprises the affinity-modified domain of SEQ ID NO:241 or a polypeptide that contains the amino acid substitutions of SEQ ID NO:241, or iii) a sequence of i) or ii) having degenerate codons.

In some embodiments, provided are CAR-related transmembrane immunomodulatory proteins in which the endodomain of a transmembrane immunomodulatory protein comprises a cytoplasmic signaling domain that comprises at least one ITAM (immunoreceptor tyrosine-based activation motif)-containing signaling domain. ITAM is a conserved motif found in a number of protein signaling domains involved in signal transduction of immune cells, including in the CD3-zeta chain ("CD3-z") involved in T-cell receptor signal transduction. In some embodiments, the endodomain comprises at CD3-zeta signaling domain. In some embodiments, the CD3-zeta signaling domain comprises the sequence of amino acids set forth in SEQ ID NO: 333 or a sequence of amino acids that exhibits at least 85%, 86%, 87%, 88%, 89%, 90%, 91%, 92%, 93%, 94%, 95%, 96%, 97%, 98% or 99% to SEQ ID NO:247 and retains the activity of T cell signaling. In some embodiments, the endodomain of a CAR-related transmembrane immunomodulatory protein can further comprise a costimulatory signaling domain to further modulate immunomodulatory responses of the T-cell. In some embodiments, the costimulatory signaling domain is CD28, ICOS, 41BB or OX40. In some embodiments, the costimulatory signaling domain is a derived from CD28 or 4-1BB and comprises the sequence of amino acids set forth in any of SEQ ID NOS: 400-403 or a sequence of amino acids that exhibits at least 85%, 86%, 87%, 88%, 89%, 90%, 91%, 92%, 93%, 94%, 95%, 96%, 97%, 98% or 99% to SEQ ID NO:400-403 and retains the activity of T cell costimulatory signaling. In some embodiments, the provided CAR-related transmembrane immunomodulatory proteins have features of CARs to stimulate T cell signaling upon binding of an affinity modified IgSF domain to a cognate binding partner or counter structure. In some embodiments, upon specific binding by the affinity-modified IgSF domain to its counter structure can lead to changes in the immunological activity of the T-cell activity as reflected by changes in cytotoxicity, proliferation or cytokine production.

In some embodiments, the transmembrane immunomodulatory protein does not contain an endodomain capable of mediating cytoplasmic signaling. In some embodiments, the transmembrane immunomodulatory protein lacks the signal transduction mechanism of the wild-type or unmodified polypeptide and therefore does not itself induce cell signaling. In some embodiments, the transmembrane immunomodulatory protein lacks an intracellular (cytoplasmic) domain or a portion of the intracellular domain of the corresponding wild-type or unmodified polypeptide, such as a cytoplasmic signaling domain contained in the sequence of amino acids set forth in SEQ ID NO: 1 (see Table 2). In some embodiments, the transmembrane immunomodulatory protein does not contain an ITIM (immunoreceptor tyrosine-based inhibition motif), such as contained in certain inhibitory receptors, including inhibitory receptors of the IgSF family (e.g. PD-1 or TIGIT). Thus, in some embodiments, the transmembrane immunomodulatory protein only contains the ectodomain and the transmembrane domain, such as any as described.

2. Secreted Immunomodulatory Proteins and Engineered Cells

In some embodiments, the CD80 variant immunomodulatory polypeptide containing any one or more of the amino acid mutations as described herein, is secretable, such as when expressed from a cell. Such a variant CD80 immunomodulatory protein does not comprise a transmembrane domain. In some embodiments, the variant CD80 immunomodulatory protein is not conjugated to a half-life extending moiety (such as an Fc domain or a multermization domain). In some embodiments, the variant CD80 immunomodulatory protein comprises a signal peptide, e.g. an antibody signal peptide or other efficient signal sequence to get domains outside of cell. When the immunomodulatory protein comprises a signal peptide and is expressed by an engineered cell, the signal peptide causes the immunomodulatory protein to be secreted by the engineered cell. Generally, the signal peptide, or a portion of the signal peptide, is cleaved from the immunomodulatory protein with secretion. The immunomodulatory protein can be encoded by a nucleic acid (which can be part of an expression vector). In some embodiments, the immunomodulatory protein is expressed and secreted by a cell (such as an immune cell, for example a primary immune cell).

Thus, in some embodiments, there are provided variant CD80 immunomodulatory proteins that further comprises a signal peptide. In some embodiments, provided herein is a nucleic acid molecule encoding the variant CD80 immunomodulatory protein operably connected to a secretion sequence encoding the signal peptide.

A signal peptide is a sequence on the N-terminus of an immunomodulatory protein that signals secretion of the immunomodulatory protein from a cell. In some embodiments, the signal peptide is about 5 to about 40 amino acids in length (such as about 5 to about 7, about 7 to about 10, about 10 to about 15, about 15 to about 20, about 20 to about 25, or about 25 to about 30, about 30 to about 35, or about 35 to about 40 amino acids in length).

In some embodiments, the signal peptide is a native signal peptide from the corresponding wild-type CD80 (see Table 2). In some embodiments, the signal peptide is a non-native signal peptide. For example, in some embodiments, the non-native signal peptide is a mutant native signal peptide from the corresponding wild-type CD80, and can include one or more (such as 2, 3, 4, 5, 6, 7, 8, 9, or 10 or more) substitutions insertions or deletions. In some embodiments, the non-native signal peptide is a signal peptide or mutant thereof of a family member from the same IgSF family as the wild-type IgSF family member. In some embodiments, the non-native signal peptide is a signal peptide or mutant thereof from an IgSF family member from a different IgSF family that the wild-type IgSF family member. In some embodiments, the signal peptide is a signal peptide or mutant thereof from a non-IgSF protein family, such as a signal peptide from an immunoglobulin (such as IgG heavy chain or IgG-kappa light chain), a cytokine (such as interleukin-2 (IL-2), or CD33), a serum albumin protein (e.g. HSA or albumin), a human azurocidin preprotein signal sequence, a luciferase, a trypsinogen (e.g. chumotrypsinogen or trypsinogen) or other signal peptide able to efficiently secrete a protein from a cell. Exemplary signal peptides include any described in the Table 6.

TABLE 6

Exemplary Signal Peptides

| SEQ ID NO | Signal Peptide | Peptide Sequence |
|---|---|---|
| SEQ ID NO: 353 | HSA signal peptide | MKWVTFISLLFLFSSAYS |
| SEQ ID NO: 354 | Ig kappa light chain | MDMRAPAGIFGFLLVLFPGYRS |

TABLE 6-continued

| Exemplary Signal Peptides | | |
|---|---|---|
| SEQ ID NO | Signal Peptide | Peptide Sequence |
| SEQ ID NO: 355 | human azurocidin preprotein signal sequence | MTRLTVLALLAGLLASSRA |
| SEQ ID NO: 356 | IgG heavy chain signal peptide | MELGLSWIFLLAILKGVQC |
| SEQ ID NO: 357 | IgG heavy chain signal peptide | MELGLRWVFLVAILEGVQC |
| SEQ ID NO: 358 | IgG heavy chain signal peptide | MKHLWFFLLLVAAPRWVLS |
| SEQ ID NO: 359 | IgG heavy chain signal peptide | MDWTWRILFLVAAATGAHS |
| SEQ ID NO: 360 | IgG heavy chain signal peptide | MDWTWRFLFVVAAATGVQS |
| SEQ ID NO: 361 | IgG heavy chain signal peptide | MEFGLSWLFLVAILKGVQC |
| SEQ ID NO: 362 | IgG heavy chain signal peptide | MEFGLSWVFLVALFRGVQC |
| SEQ ID NO: 363 | IgG heavy chain signal peptide | MDLLHKNMKHLWFFLLLVAAPRWVLS |
| SEQ ID NO: 364 | IgG Kappa light chain signal sequences: | MDMRVPAQLLGLLLLWLSGARC |
| SEQ ID NO: 365 | IgG Kappa light chain signal sequences: | MKYLLPTAAAGLLLLAAQPAMA |
| SEQ ID NO: 366 | Gaussia luciferase | MGVKVLFALICIAVAEA |
| SEQ ID NO: 367 | Human albumin | MKWVTFISLLFLFSSAYS |
| SEQ ID NO: 368 | Human chymotrypsinogen | MAFLWLLSCWALLGTTFG |
| SEQ ID NO: 369 | Human interleukin-2 | MQLLSCIALILALV |
| SEQ ID NO: 370 | Human trypsinogen-2 | MNLLLILTFVAAAVA |

In some embodiments of a secretable variant CD80 immunomodulatory protein, the immunomodulatory protein comprises a signal peptide when expressed, and the signal peptide (or a portion thereof) is cleaved from the immunomodulatory protein upon secretion.

In some embodiments, the engineered cells express a variant CD80 polypeptides that are secreted from the cell. In some embodiments, such a variant CD80 polypeptide is encoded by a nucleic acid molecule encoding an immunomodulatory protein under the operable control of a signal sequence for secretion. In some embodiments, the encoded immunomodulatory protein is secreted when expressed from a cell. In some embodiments, the immunomodulatory protein encoded by the nucleic acid molecule does not comprise a transmembrane domain. In some embodiments, the immunomodulatory protein encoded by the nucleic acid molecule does not comprise a half-life extending moiety (such as an Fc domain or a multimerization domain). In some embodiments, the immunomodulatory protein encoded by the nucleic acid molecule comprises a signal peptide. In some embodiments, a nucleic acid of the invention further comprises nucleotide sequence that encodes a secretory or signal peptide operably linked to the nucleic acid encoding the immunomodulatory protein, thereby allowing for secretion of the immunomodulatory protein 3. Cells and Engineering Cells Provided herein are engineered cells expressing any of the provided immunomodulatory polypeptide. In some embodiments, the engineered cells express on their surface any of the provided transmembrane immunomodulatory polypeptides. In some embodiments, the engineered cells express and are capable of or are able to secrete the immunomodulatory protein from the cells under conditions suitable for secretion of the protein. In some embodiments, the immunomodulatory protein is expressed on a lymphocyte such as a tumor infiltrating lymphocyte (TIL), T-cell or NK cell, or on a myeloid cell. In some embodiments, the engineered cells are antigen presenting cells (APCs). In some embodiments, the engineered cells are engineered mammalian T-cells or engineered mammalian antigen presenting cells (APCs). In some embodiments, the engineered T-cells or APCs are human or murine cells.

In some embodiments, engineered T-cells include, but are not limited to, T helper cell, cytotoxic T-cell (alternatively, cytotoxic T lymphocyte or CTL), natural killer T-cell, regulatory T-cell, memory T-cell, or gamma delta T-cell. In some embodiments, the engineered T cells are CD4+ or CD8+. In addition to the signal of the MHC, engineered T-cells also require a co-stimulatory signal, which in some embodiments is provided by a variant CD80 transmembrane immunomodulatory polypeptide expressed in membrane bound form as discussed previously.

In some embodiments, the engineered APCs include, for example, MHC II expressing APCs such as macrophages, B cells, and dendritic cells, as well as artificial APCs (aAPCs) including both cellular and acellular (e.g., biodegradable polymeric microparticles) aAPCs. Artificial APCs (aAPCs) are synthetic versions of APCs that can act in a similar manner to APCs in that they present antigens to T-cells as well as activate them. Antigen presentation is performed by the MHC (Class I or Class II). In some embodiments, in engineered APCs such as aAPCs, the antigen that is loaded onto the MHC is, in some embodiments, a tumor specific antigen or a tumor associated antigen. The antigen loaded onto the MHC is recognized by a T-cell receptor (TCR) of a T cell, which, in some cases, can express CTLA-4 or CD80 or other molecule recognized by the variant CD80 polypeptides provided herein. Materials which can be used to engineer an aAPC include: poly (glycolic acid), poly(lactic-co-glycolic acid), iron-oxide, liposomes, lipid bilayers, sepharose, and polystyrene.

In some embodiments, an immunomodulatory protein, such as a transmembrane immunomodulatory protein or a secretable immunomodulatory protein, provided herein is co-expressed or engineered into a cell that expresses an antigen-binding receptor, such as a recombinant receptor, such as a chimeric antigen receptor (CAR) or T cell receptor (TCR). In some embodiments, the engineered cell, such as an engineered T cell, recognizes a desired antigen associated with cancer, inflammatory and autoimmune disorders, or a viral infection. In specific embodiments, the antigen-binding receptor contains an antigen-binding moiety that specifically binds a tumor specific antigen or a tumor associated antigen. In some embodiments, the engineered T-cell is a CAR (chimeric antigen receptor) T-cell that contains an antigen-binding domain (e.g. scFv) that specifically binds to an antigen, such as a tumor specific antigen or tumor associated antigen. In some embodiments, the antigen-binding domain (e.g. scFv) is specific for CD19. Exemplary of a CAR is an anti-CD19 CAR, such as a CAR containing an anti-CD19 scFv set forth in SEQ ID NO:245. In some embodiments, the TIP protein is expressed in an engineered T-cell receptor cell or and engineered chimeric antigen receptor cell. In such embodiments, the engineered cell co-expresses the TIP and the CAR or TCR.

In some embodiments, the CAR further contains a spacer or hinge, a transmembrane domain, and an intracellular signaling domain (endodomain) comprising an ITAM signaling domain, such as a CD3zeta signaling domain. In some embodiments, the CAR further includes a costimulatory signaling domain. In some embodiments, the spacer or hinge is present between the antigen-binding domain and the transmembrane domain, such as is between the antigen-binding domain and plasma membrane when expressed on a cell. In some embodiments, the spacer or hinge is derived from IgG subclass (such as IgG1 and IgG4, IgD or CD8 (see e.g., Qin et al. (2017) J. Hematol. Oncol., 10:68). In some embodiments, the spacer or hinge is derived from IgG1.

In some embodiments, the spacer and transmembrane domain are the hinge and transmembrane domain derived from CD8, such as set forth in SEQ ID NO: 246 or 399 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO:332 or 364. In some embodiments, the endodomain comprises at CD3-zeta signaling domain. In some embodiments, the CD3-zeta signaling domain comprises the sequence of amino acids set forth in SEQ ID NO: 247 or a sequence of amino acids that exhibits at least 85%, 86%, 87%, 88%, 89%, 90%, 91%, 92%, 93%, 94%, 95%, 96%, 97%, 98% or 99% to SEQ ID NO:247 and retains the activity of T cell signaling. In some embodiments, the endodomain of a CAR-related transmembrane immunomodulatory protein can further comprise a costimulatory signaling domain to further modulate immunomodulatory responses of the T-cell. In some embodiments, the costimulatory signaling domain is CD28, ICOS, 41BB or OX40. In some embodiments, the costimulatory signaling domain is a derived from CD28 or 4-1BB and comprises the sequence of amino acids set forth in any of SEQ ID NOS: 400-403 or a sequence of amino acids that exhibits at least 85%, 86%, 87%, 88%, 89%, 90%, 91%, 92%, 93%, 94%, 95%, 96%, 97%, 98% or 99% to SEQ ID NO:400-403 and retains the activity of T cell costimulatory signaling.

In another embodiment, the engineered T-cell possesses a TCR, including a recombinant or engineered TCR. In some embodiments, the TCR can be a native TCR. Those of skill in the art will recognize that generally native mammalian T-cell receptors comprise an alpha and a beta chain (or a gamma and a delta chain) involved in antigen specific recognition and binding. In some embodiments, the TCR is an engineered TCR that is modified. In some embodiments, the TCR of an engineered T-cell specifically binds to a tumor associated or tumor specific antigen presented by an APC.

In some embodiments, the immunomodulatory polypeptides, such as transmembrane immunomodulatory polypeptides or secretable immunomodulatory polypeptides, can be incorporated into engineered cells, such as engineered T cells or engineered APCs, by a variety of strategies such as those employed for recombinant host cells. A variety of methods to introduce a DNA construct into primary T cells are known in the art. In some embodiments, viral transduction or plasmid electroporation are employed. In typical embodiments, the nucleic acid molecule encoding the immunomodulatory protein, or the expression vector, comprises a signal peptide that localizes the expressed transmembrane immunomodulatory proteins to the cellular membrane or for secretion. In some embodiments, a nucleic acid encoding a transmembrane immunomodulatory proteins of the invention is sub-cloned into a viral vector, such as a retroviral vector, which allows expression in the host mammalian cell. The expression vector can be introduced into a mammalian host cell and, under host cell culture conditions, the immunomodulatory protein is expressed on the surface or is secreted.

In an exemplary example, primary T-cells can be purified ex vivo (CD4 cells or CD8 cells or both) and stimulated with an activation protocol consisting of various TCR/CD28 agonists, such as anti-CD3/anti-CD28 coated beads. After a 2 or 3 day activation process, a recombinant expression vector containing an immunomodulatory polypeptide can be stably introduced into the primary T cells through art standard lentiviral or retroviral transduction protocols or plasmid electroporation strategies. Cells can be monitored for immunomodulatory polypeptide expression by, for example, flow cytometry using anti-epitope tag or antibodies that cross-react with native parental molecule and polypeptides comprising variant CD80. T-cells that express the immunomodulatory polypeptide can be enriched through sorting with anti-epitope tag antibodies or enriched for high or low expression depending on the application.

Upon immunomodulatory polypeptide expression the engineered T-cell can be assayed for appropriate function by a variety of means. The engineered CAR or TCR co-expression can be validated to show that this part of the engineered T cell was not significantly impacted by the expression of the immunomodulatory protein. Once validated, standard in vitro cytotoxicity, proliferation, or cytokine assays (e.g., IFN-gamma expression) can be used to assess the function of engineered T-cells. Exemplary standard endpoints are percent lysis of the tumor line, proliferation of the engineered T-cell, or IFN-gamma protein expression in culture supernatants. An engineered construct which results in statistically significant increased lysis of tumor line, increased proliferation of the engineered T-cell, or increased IFN-gamma expression over the control construct can be selected for. Additionally, non-engineered, such as native primary or endogenous T-cells could also be incorporated into the same in vitro assay to measure the ability of the immunomodulatory polypeptide construct expressed on the engineered cells, such as engineered T-cells, to modulate activity, including, in some cases, to activate and generate effector function in bystander, native T-cells. Increased expression of activation markers such as CD69, CD44, or CD62L could be monitored on endogenous T cells, and increased proliferation and/or cytokine production could indicate desired activity of the immunomodulatory protein expressed on the engineered T cells.

In some embodiments, the similar assays can be used to compare the function of engineered T cells containing the CAR or TCR alone to those containing the CAR or TCR and a TIP construct. Typically, these in vitro assays are performed by plating various ratios of the engineered T cell and a "tumor" cell line containing the cognate CAR or TCR antigen together in culture. Standard endpoints are percent lysis of the tumor line, proliferation of the engineered T cell, or IFN-gamma production in culture supernatants. An engineered immunomodulatory protein which resulted in statistically significant increased lysis of tumor line, increased proliferation of the engineered T cell, or increased IFN-gamma production over the same TCR or CAR construct alone can be selected for. Engineered human T cells can be analyzed in immunocompromised mice, like the NSG strain, which lacks mouse T, NK and B cells. Engineered human T cells in which the CAR or TCR binds a target counter-structure on the xenograft and is co-expressed with the TIP affinity modified IgSF domain can be adoptively transferred in vivo at different cell numbers and ratios compared to the xenograft. For example, engraftment of CD19+ leukemia tumor lines containing a luciferase/GFP vector can be monitored through bioluminescence or ex vivo by flow cytometry. In a common embodiment, the xenograft is introduced into the murine model, followed by the engineered T cells several days later. Engineered T cells containing the immunomodulatory protein can be assayed for increased survival, tumor clearance, or expanded engineered T cells numbers relative to engineered T cells containing the CAR or TCR alone. As in the in vitro assay, endogenous, native (i.e., non-engineered) human T cells could be co-adoptively transferred to look for successful epitope spreading in that population, resulting in better survival or tumor clearance.

E. Infectious Agents Expressing Variant Polypeptides and Immunomodulatory Proteins Also provided are infectious agents that contain nucleic acids encoding any of the variant polypeptides, such as CD80 vIgD polypeptides, including secretable or transmembrane immunomodulatory proteins described herein. In some embodiments, such infectious agents can deliver the nucleic acids encoding the variant immunomodulatory polypeptides described herein, such as CD80 vIgD polypeptides, to a target cell in a subject, e.g., immune cell and/or antigen-presenting cell (APC) or tumor cell in a subject. Also provided are nucleic acids contained in such infectious agents, and/or nucleic acids for generation or modification of such infectious agents, such as vectors and/or plasmids, and compositions containing such infectious agents.

In some embodiments, the infectious agent is a microorganism or a microbe. In some embodiments, the infectious agent is a virus or a bacterium. In some embodiments, the infectious agent is a virus. In some embodiments, the infectious agent is a bacterium. In some embodiments, such infectious agents can deliver nucleic acid sequences encoding any of the variant polypeptides, such as CD80 vIgD polypeptides, including secretable or transmembrane immunomodulatory proteins, described herein. Thus, in some embodiments, the cell in a subject that is infected or contacted by the infectious agents can be rendered to express on the cell surface or secrete, the variant immunomodulatory polypeptides. In some embodiments, the infectious agent can also deliver one or more other therapeutics or nucleic acids encoding other therapeutics to the cell and/or to an environment within the subject. In some embodiments, other therapeutics that can be delivered by the infectious agents include cytokines or other immunomodulatory molecules.

In some embodiments, the infectious agent, e.g., virus or bacteria, contains nucleic acid sequences that encode any of the variant polypeptides, such as CD80 vIgD polypeptides, including secretable or transmembrane immunomodulatory proteins, described herein, and by virtue of contact and/or infection of a cell in the subject, the cell expresses the variant polypeptides, such as CD80 vIgD polypeptides, including secretable or transmembrane immunomodulatory proteins, encoded by the nucleic acid sequences contained in the infectious agent. In some embodiments, the infectious agent can be administered to the subject. In some embodiments, cells from the subject can be transduced by the infectious agent ex vivo.

In some embodiments, the variant polypeptides, such as CD80 vIgD polypeptides, including transmembrane immunomodulatory proteins, expressed by the cell infected by the infectious agent is a transmembrane protein and is surface expressed. In some embodiments, the variant polypeptides, such as CD80 vIgD polypeptides, including secretable immunomodulatory proteins, expressed by the cell infected by the infectious agent is expressed and secreted from the cell. The transmembrane immunomodulatory protein or secreted immunomodulatory protein can be any described herein.

In some embodiments, the cells in the subject that are targeted by the infectious agent include a tumor cell, an immune cell, and/or an antigen-presenting cell (APC). In some embodiments, the infectious agent targets a cell in the tumor microenvironment (TME). In some embodiments, the infectious agent delivers the nucleic acids encoding the variant polypeptides, such as CD80 vIgD polypeptides, including secretable or transmembrane immunomodulatory proteins, to an appropriate cell (for example, an APC, such as a cell that displays a peptide/MHC complex on its cell surface, such as a dendritic cell) or tissue (e.g., lymphoid tissue) that will induce and/or augment the desired effect, e.g., immunomodulation and/or a specific cell-medicated immune response, e.g., CD4 and/or CD8 T cell response, which CD8 T cell response may include a cytotoxic T cell (CTL) response. In some embodiments, the infectious agent targets an APC, such as a dendritic cell (DC). In some embodiments, the nucleic acid molecule delivered by the infectious agents described herein include appropriate nucleic acid sequences necessary for the expression of the operably linked coding sequences encoding the variant immunomodulatory polypeptides, in a particular target cell, e.g., regulatory elements such as promoters.

In some embodiments, the infectious agent that contains nucleic acid sequences encoding the immunomodulatory polypeptides can also contain nucleic acid sequences that encode one or more additional gene products, e.g., cytokines, prodrug converting enzymes, cytotoxins and/or detectable gene products. For example, in some embodiments, the infectious agent is an oncolytic virus and the virus can include nucleic acid sequences encoding additional therapeutic gene products (see, e.g., Kim et al., (2009) Nat Rev Cancer 9:64-71; Garcia-Aragoncillo et al., (2010) Curr Opin Mol Ther 12:403-411; see U.S. Pat. Nos. 7,588,767, 7,588,771, 7,662,398 and 7,754,221 and U.S. Pat. Publ. Nos. 2007/0202572, 2007/0212727, 2010/0062016, 2009/0098529, 2009/0053244, 2009/0155287, 2009/0117034, 2010/0233078, 2009/0162288, 2010/0196325, 2009/0136917 and 2011/0064650. In some embodiments, the additional gene product can be a therapeutic gene product that can result in death of the target cell (e.g., tumor cell) or gene products that can augment or boost or regulate an immune response (e.g., cytokine). Exemplary gene products also include among an anticancer agent, an anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic gene product, a cell matrix degradative gene, genes for tissue regeneration and reprogramming human somatic cells to pluripotency, and other genes described herein or known to one of skill in the art. In some embodiments, the additional gene product is Granulocyte-macrophage colony-stimulating factor (GM-CSF).

1. Viruses

In some embodiments, the infectious agent is a virus. In some embodiments, the infectious agent is an oncolytic virus, or a virus that targets particular cells, e.g., immune cells. In some embodiments, the infectious agent targets a tumor cell and/or cancer cell in the subject. In some embodiments, the infectious agent targets an immune cell or an antigen-presenting cell (APC).

In some embodiments, the infectious agent is an oncolytic virus. Oncolytic viruses are viruses that accumulate in tumor cells and replicate in tumor cells. By virtue of replication in the cells, and optional delivery of nucleic acids encoding variant immunomodulatory variant CD80 polypeptides or immunomodulatory proteins described herein, tumor cells are lysed, and the tumor shrinks and can be eliminated. Oncolytic viruses can also have a broad host and cell type range. For example, oncolytic viruses can accumulate in immunoprivileged cells or immunoprivileged tissues, including tumors and/or metastases, and also including wounded tissues and cells, thus allowing the delivery and expression of nucleic acids encoding the variant immunomodulatory polypeptides described herein in a broad range of cell types. Oncolytic viruses can also replicate in a tumor cell specific manner, resulting in tumor cell lysis and efficient tumor regression.

Exemplary oncolytic viruses include adenoviruses, adeno-associated viruses, herpes viruses, Herpes Simplex Virus, Vesticular Stomatic virus, Reovirus, Newcastle Disease virus, parvovirus, measles virus, vesticular stomatitis virus (VSV), Coxsackie virus and Vaccinia virus. In some embodiments, oncolytic viruses can specifically colonize solid tumors, while not infecting other organs, and can be used as an infectious agent to deliver the nucleic acids encoding the variant immunomodulatory polypeptides described herein to such solid tumors.

Oncolytic viruses for use in delivering the nucleic acids encoding variant CD80 polypeptides or immunomodulatory proteins described herein, can be any of those known to one of skill in the art and include, for example, vesicular stomatitis virus, see, e.g., U.S. Pat. Nos. 7,731,974, 7,153,510, 6,653,103 and U.S. Pat. Pub. Nos. 2010/0178684, 2010/0172877, 2010/0113567, 2007/0098743, 20050260601, 20050220818 and EP Pat. Nos. 1385466, 1606411 and 1520175; herpes simplex virus, see, e.g., U.S. Pat. Nos. 7,897,146, 7,731,952, 7,550,296, 7,537,924, 6,723,316, 6,428,968 and U.S. Pat. Pub. Nos., 2014/0154216, 2011/0177032, 2011/0158948, 2010/0092515, 2009/0274728, 2009/0285860, 2009/0215147, 2009/0010889, 2007/0110720, 2006/0039894, 2004/0009604, 2004/0063094, International Patent Pub. Nos., WO 2007/052029, WO 1999/038955; retroviruses, see, e.g., U.S. Pat. Nos. 6,689,871, 6,635,472, 5,851,529, 5,716,826, 5,716,613 and U.S. Pat. Pub. No. 20110212530; vaccinia viruses, see, e.g., 2016/0339066, and adeno-associated viruses, see, e.g., U.S. Pat. Nos. 8,007,780, 7,968,340, 7,943,374, 7,906,111, 7,927,585, 7,811,814, 7,662,627, 7,241,447, 7,238,526, 7,172,893, 7,033,826, 7,001,765, 6,897,045, and 6,632,670.

Oncolytic viruses also include viruses that have been genetically altered to attenuate their virulence, to improve their safety profile, enhance their tumor specificity, and they have also been equipped with additional genes, for example cytotoxins, cytokines, prodrug converting enzymes to improve the overall efficacy of the viruses (see, e.g., Kirn et al., (2009) Nat Rev Cancer 9:64-71; Garcia-Aragoncillo et al., (2010) Curr Opin Mol Ther 12:403-411; see U.S. Pat. Nos. 7,588,767, 7,588,771, 7,662,398 and 7,754,221 and U.S. Pat. Publ. Nos. 2007/0202572, 2007/0212727, 2010/0062016, 2009/0098529, 2009/0053244, 2009/0155287, 2009/0117034, 2010/0233078, 2009/0162288, 2010/0196325, 2009/0136917 and 2011/0064650). In some embodiments, the oncolytic viruses can be those that have been modified so that they selectively replicate in cancerous cells, and, thus, are oncolytic. For example, the oncolytic virus is an adenovirus that has been engineered to have modified tropism for tumor therapy and also as gene therapy vectors. Exemplary of such is ONYX-015, H101 and Ad5ΔCR (Hallden and Portella (2012) Expert Opin Ther Targets, 16:945-58) and TNFerade (McLoughlin et al. (2005) Ann. Surg. Oncol., 12:825-30), or a conditionally replicative adenovirus Oncorine®.

In some embodiments, the infectious agent is a modified herpes simplex virus. In some embodiments, the infectious agent is a modified version of Talimogene laherparepvec (also known as T-Vec, Imlygic or OncoVex GM-CSF), that is modified to contain nucleic acids encoding any of the variant immunomodulatory polypeptides described herein, such as any of the variant CD80 polypeptides or immunomodulatory proteins described herein. In some embodiments, the infectious agent is a modified herpes simplex virus that is described, e.g., in WO 2007/052029, WO 1999/038955, US 2004/0063094, US 2014/0154216, or, variants thereof.

In some embodiments, the infectious agent is a virus that targets a particular type of cells in a subject that is administered the virus, e.g., a virus that targets immune cells or antigen-presenting cells (APCs). Dendritic cells (DCs) are essential APCs for the initiation and control of immune responses. DCs can capture and process antigens, migrate from the periphery to a lymphoid organ, and present the antigens to resting T cells in a major histocompatibility complex (MHC)-restricted fashion. In some embodiments, the infectious agent is a virus that specifically can target DCs to deliver nucleic acids encoding the variant CD80 polypeptides or immunomodulatory proteins for expression in DCs. In some embodiments, the virus is a lentivirus or a variant thereof. In some embodiments, the virus is a lentivirus that is pseudotyped to efficiently bind to and productively infect cells expressing the cell surface marker dendritic cell-specific intercellular adhesion molecule-3-grabbing non-integrin (DC-SIGN), such as DCs. In some embodiments, the virus is a lentivirus pseudotyped with a Sindbis virus E2 glycoprotein, such as those described in WO 2013/149167. In some embodiments, the virus allows for delivery and expression of a sequence of interest (e.g., a nucleic acid encoding any of the variant CD80 polypeptides or immunomodulatory proteins described herein) to a DC. In some embodiments, the virus includes those described in WO 2008/011636 or US 2011/0064763, or variants thereof.

2. Bacteria

In some embodiments, the infectious agent is a bacterium. For example, in some embodiments, the bacteria can deliver nucleic acids encoding any of the variant immunomodulatory polypeptides described herein, e.g., variant CD80 polypeptide or immunomodulatory protein, to a target cell in the subject, such as a tumor cell, an immune cell, an antigen-presenting cell and/or a phagocytic cell. In some embodiments, the bacterium can be preferentially targeted to a specific environment within a subject, such as a tumor microenvironment (TME), for expression and/or secretion of the variant immunomodulatory polypeptides and/or to target specific cells in the environment for expression of the variant immunomodulatory polypeptides.

In some embodiments, the bacterium delivers the nucleic acids to the cells via bacterial-mediated transfer of plasmid DNA to mammalian cells (also referred to as "bactofection"). For example, in some embodiments, delivery of genetic material is achieved through entry of the entire bacterium into target cells. In some embodiments, spontaneous or induced bacterial lysis can lead to the release of plasmid for subsequent eukaryotic cell expression. In some embodiments, the bacterium can deliver nucleic acids to non-phagocytic mammalian cells (e.g., tumor cells) and/or to phagocytic cells, e.g., certain immune cells and/or APCs. In some embodiments, the nucleic acids delivered by the bacterium can be transferred to the nucleus of the cell in the subject for expression. In some embodiments, the nucleic acids also include appropriate nucleic acid sequences necessary for the expression of the operably linked sequences encoding the variant immunomodulatory polypeptides in a particular host cell, e.g., regulatory elements such as promoters or enhancers. In some embodiments, the infectious agent that is a bacterium can deliver nucleic acids encoding the immunomodulatory proteins in the form of an RNA, such as a pre-made translation-competent RNA delivered to the cytoplasm of the target cell for translation by the target cell's machinery.

In some embodiments, the bacterium can replicate and lyse the target cells, e.g., tumor cells. In some embodiments, the bacterium can contain and/or release nucleic acid sequences and/or gene products in the cytoplasm of the target cells, thereby killing the target cell, e.g., tumor cell. In some embodiments, the infectious agent is bacterium that can replicate specifically in a particular environment in the subject, e.g., tumor microenvironment (TME). For example, in some embodiments, the bacterium can replicate specifically in anaerobic or hypoxic microenvironments. In some embodiments, conditions or factors present in particular environments, e.g., aspartate, serine, citrate, ribose or galactose produced by cells in the TME, can act as chemoattractants to attract the bacterium to the environment. In some embodiments, the bacterium can express and/or secrete the immunomodulatory proteins described herein in the environment, e.g., TME.

In some embodiments, the infectious agent is a bacterium that is a *Listeria* sp., a *Bifidobacterium* sp., an *Escherichia* sp., a *Closteridium* sp., a *Salmonella* sp., a *Shigella* sp., a *Vibrio* sp. or a *Yersinia* sp. In some embodiments, the bacterium is selected from among one or more of *Listeria monocytogenes, Salmonella typhimurium, Salmonella choleraesuis, Escherichia coli, Vibrio cholera, Clostridium perfringens, Clostridium butyricum, Clostridium novyi, Clostridium acetobutylicum, Bifidobacterium infantis, Bifidobacterium longum* and *Bifidobacterium adolescentis*. In some embodiments, the bacterium is an engineered bacterium. In some embodiments, the bacterium is an engineered bacterium such as those described in, e.g., Seow and Wood (2009) Molecular Therapy 17(5):767-777; Baban et al. (2010) Bioengineered Bugs 1:6, 385-394; Patyar et al. (2010) J Biomed Sci 17:21; Tangney et al. (2010) Bioengineered Bugs 1:4, 284-287; van Pijkeren et al. (2010) Hum Gene Ther. 21(4):405-416; WO 2012/149364; WO 2014/198002; U.S. Pat. Nos. 9,103,831; 9,453,227; US 2014/0186401; US 2004/0146488; US 2011/0293705; US 2015/0359909 and EP 3020816. The bacterium can be modified to deliver nucleic acid sequences encoding any of the variant immunomodulatory polypeptides, conjugates and/or fusions provided herein, and/or to express such variant immunomodulatory polypeptides in the subject.

F. Nucleic Acids, Vectors and Methods for Producing the Polypeptides or Cells

Provided herein are isolated or recombinant nucleic acids collectively referred to as "nucleic acids" which encode any of the various provided embodiments of the variant CD80 polypeptides or immunomodulatory polypeptides provided herein. In some embodiments, nucleic acids provided herein, including all described below, are useful in recombinant production (e.g., expression) of variant CD80 polypeptides or immunomodulatory polypeptides provided herein. In some embodiments, nucleic acids provided herein, including all described below, are useful in expression of variant CD80 polypeptides or immunomodulatory polypeptides provided herein in cells, such as in engineered cells, e.g. immune cells, or infectious agent cells. The nucleic acids provided herein can be in the form of RNA or in the form of DNA, and include mRNA, cRNA, recombinant or synthetic RNA and DNA, and cDNA. The nucleic acids provided herein are typically DNA molecules, and usually double-stranded DNA molecules. However, single-stranded DNA, single-stranded RNA, double-stranded RNA, and hybrid DNA/RNA nucleic acids or combinations thereof comprising any of the nucleotide sequences of the invention also are provided.

Also provided herein are recombinant expression vectors and recombinant host cells useful in producing the variant CD80 polypeptides or immunomodulatory polypeptides provided herein.

Also provided herein are engineered cells, such as engineered immune cells, containing any of the provided nucleic acid molecules or the encoded variant CD80 polypeptides or immunomodulatory polypeptides, such as any of the transmembrane immunomodulatory polypeptides or secretable immunomodulatory polypeptides.

Also provided herein are infectious agents, such as bacterial or viral cells, containing any of the provided nucleic acid molecules or the encoded variant CD80 polypeptides or immunomodulatory polypeptides, such as any of the transmembrane immunomodulatory polypeptides or secretable immunomodulatory polypeptides.

In any of the above provided embodiments, the nucleic acids encoding the immunomodulatory polypeptides provided herein can be introduced into cells using recombinant DNA and cloning techniques. To do so, a recombinant DNA molecule encoding a immunomodulatory polypeptide is prepared. Methods of preparing such DNA molecules are well known in the art. For instance, sequences coding for the peptides could be excised from DNA using suitable restriction enzymes. Alternatively, the DNA molecule could be synthesized using chemical synthesis techniques, such as the phosphoramidite method. Also, a combination of these techniques could be used. In some instances, a recombinant or synthetic nucleic acid may be generated through polymerase chain reaction (PCR). In some embodiments, a DNA insert can be generated encoding one or more variant CD80 polypeptides containing at least one affinity-modified IgSF domain and, in some embodiments, a signal peptide, a transmembrane domain and/or an endodomain in accord with the provided description. This DNA insert can be cloned into an appropriate transduction/transfection vector as is known to those of skill in the art. Also provided are expression vectors containing the nucleic acid molecules.

In some embodiments, the expression vectors are capable of expressing the immunomodulatory proteins in an appropriate cell under conditions suited to expression of the protein. In some aspects, nucleic acid molecule or an expression vector comprises the DNA molecule that encodes the immunomodulatory protein operatively linked to appropriate expression control sequences. Methods of effecting this operative linking, either before or after the DNA molecule is inserted into the vector, are well known. Expression control sequences include promoters, activators, enhancers, operators, ribosomal binding sites, start signals, stop signals, cap signals, polyadenylation signals, and other signals involved with the control of transcription or translation.

In some embodiments, expression of the immunomodulatory protein is controlled by a promoter or enhancer to control or regulate expression. The promoter is operably linked to the portion of the nucleic acid molecule encoding the variant polypeptide or immunomodulatory protein. In some embodiments, the promotor is a constitutively active promotor (such as a tissue-specific constitutively active promotor or other constitutive promotor). In some embodiments, the promotor is an inducible promotor, which may be responsive to an inducing agent (such as a T cell activation signal).

In some embodiments, a constitutive promoter is operatively linked to the nucleic acid molecule encoding the variant polypeptide or immunomodulatory protein. Exemplary constitutive promoters include the Simian vacuolating virus 40 (SV40) promoter, the cytomegalovirus (CMV) promoter, the ubiquitin C (UbC) promoter, and the EF-1 alpha (EFla) promoter. In some embodiments, the constitutive promoter is tissue specific. For example, in some embodiments, the promoter allows for constitutive expression of the immunomodulatory protein in specific tissues, such as immune cells, lymphocytes, or T cells. Exemplary tissue-specific promoters are described in U.S. Pat. No. 5,998,205, including, for example, a fetoprotein, DF3, tyrosinase, CEA, surfactant protein, and ErbB2 promoters.

In some embodiments, an inducible promoter is operatively linked to the nucleic acid molecule encoding the variant polypeptide or immunomodulatory protein such that expression of the nucleic acid is controllable by controlling the presence or absence of the appropriate inducer of transcription. For example, the promoter can be a regulated promoter and transcription factor expression system, such as the published tetracycline-regulated systems or other regulatable systems (see, e.g. published International PCT Appl. No. WO 01/30843), to allow regulated expression of the encoded polypeptide. An exemplary regulatable promoter system is the Tet-On (and Tet-Off) system available, for example, from Clontech (Palo Alto, Calif.). This promoter system allows the regulated expression of the transgene controlled by tetracycline or tetracycline derivatives, such as doxycycline. Other regulatable promoter systems are known (see e.g., published U.S. Application No. 2002-0168714, entitled "Regulation of Gene Expression Using Single-Chain, Monomeric, Ligand Dependent Polypeptide Switches," which describes gene switches that contain ligand binding domains and transcriptional regulating domains, such as those from hormone receptors).

In some embodiments, the promotor is responsive to an element responsive to T-cell activation signaling. Solely by way of example, in some embodiments, an engineered T cell comprises an expression vector encoding the immunomodulatory protein and a promotor operatively linked to control expression of the immunomodulatory protein. The engineered T cell can be activated, for example by signaling through an engineered T cell receptor (TCR) or a chimeric antigen rector (CAR), and thereby triggering expression and secretion of the immunomodulatory protein through the responsive promotor.

In some embodiments, an inducible promoter is operatively linked to the nucleic acid molecule encoding the immunomodulatory protein such that the immunomodulatory protein is expressed in response to a nuclear factor of activated T-cells (NFAT) or nuclear factor kappa-light-chain enhancer of activated B cells (NF-κB). For example, in some embodiments, the inducible promoter comprises a binding site for NFAT or NF-κB. For example, in some embodiments, the promoter is an NFAT or NF-κB promoter or a functional variant thereof. Thus, in some embodiments, the nucleic acids make it possible to control the expression of immunomodulatory protein while also reducing or eliminating the toxicity of the immunomodulatory protein. In particular, engineered immune cells comprising the nucleic acids of the invention express and secrete the immunomodulatory protein only when the cell (e.g., a T-cell receptor (TCR) or a chimeric antigen receptor (CAR) expressed by the cell) is specifically stimulated by an antigen and/or the cell (e.g., the calcium signaling pathway of the cell) is non-specifically stimulated by, e.g., phorbol myristate acetate (PMA)/Ionomycin. Accordingly, the expression and, in some cases, secretion, of immunomodulatory protein can be controlled to occur only when and where it is needed (e.g., in the presence of an infectious disease-causing agent, cancer, or at a tumor site), which can decrease or avoid undesired immunomodulatory protein interactions.

In some embodiments, the nucleic acid encoding an immunomodulatory protein described herein comprises a suitable nucleotide sequence that encodes a NFAT promoter, NF-κB promoter, or a functional variant thereof. "NFAT promoter" as used herein means one or more NFAT responsive elements linked to a minimal promoter. "NF-κB promoter" refers to one or more NF-κB responsive elements linked to a minimal promoter. In some embodiments, the minimal promoter of a gene is a minimal human IL-2 promoter or a CMV promoter. The NFAT responsive elements may comprise, e.g., NFAT1, NFAT2, NFAT3, and/or NFAT4 responsive elements. The NFAT promoter, NF-κB promoter, or a functional variant thereof may comprise any number of binding motifs, e.g., at least two, at least three, at least four, at least five, or at least six, at least seven, at least eight, at least nine, at least ten, at least eleven, or up to twelve binding motifs.

The resulting recombinant expression vector having the DNA molecule thereon is used to transform an appropriate host. This transformation can be performed using methods well known in the art. In some embodiments, a nucleic acid provided herein further comprises nucleotide sequence that encodes a secretory or signal peptide operably linked to the nucleic acid encoding an immunomodulatory polypeptide such that a resultant soluble immunomodulatory polypeptide is recovered from the culture medium, host cell, or host cell periplasm. In other embodiments, the appropriate expression control signals are chosen to allow for membrane expression of an immunomodulatory polypeptide. Furthermore, commercially available kits as well as contract manufacturing companies can also be utilized to make engineered cells or recombinant host cells provided herein.

In some embodiments, the resulting expression vector having the DNA molecule thereon is used to transform, such as transduce, an appropriate cell. The introduction can be performed using methods well known in the art. Exemplary methods include those for transfer of nucleic acids encoding the receptors, including via viral, e.g., retroviral or lentiviral, transduction, transposons, and electroporation. In some embodiments, the expression vector is a viral vector. In some embodiments, the nucleic acid is transferred into cells by lentiviral or retroviral transduction methods.

Any of a large number of publicly available and well-known mammalian host cells, including mammalian T-cells or APCs, can be used in the preparing the polypeptides or engineered cells. The selection of a cell is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all cells can be equally effective for the expression of a particular DNA sequence.

In some embodiments, the host cells can be a variety of eukaryotic cells, such as in yeast cells, or with mammalian cells such as Chinese hamster ovary (CHO) or HEK293 cells. Host cells can also be prokaryotic cells, such as with *E. coli*. The transformed recombinant host is cultured under polypeptide expressing conditions, and then purified to obtain a soluble protein. Recombinant host cells can be cultured under conventional fermentation conditions so that the desired polypeptides are expressed. Such fermentation conditions are well known in the art. Finally, the polypeptides provided herein can be recovered and purified from recombinant cell cultures by any of a number of methods well known in the art, including ammonium sulfate or ethanol precipitation, acid extraction, anion or cation exchange chromatography, phosphocellulose chromatography, hydrophobic interaction chromatography, and affinity chromatography. Protein refolding steps can be used, as desired, in completing configuration of the mature protein. Finally, high performance liquid chromatography (HPLC) can be employed in the final purification steps.

In some embodiments, the cell is an immune cells, such as any described above in connection with preparing engineered cells. In some embodiments, such engineered cells are primary cells. In some embodiments, the engineered cells are autologous to the subject. In some embodiment, the engineered cells are allogeneic to the subject. In some embodiments, the engineered cells are obtained from a subject, such as by leukapheresis, and transformed ex vivo for expression of the immunomodulatory polypeptide, e.g. transmembrane immunomodulatory polypeptide or secretable immunomodulatory polypeptide.

Also provided are nucleic acids encoding any of the variant immunomodulatory polypeptides contained in infectious agents described herein. In some embodiments, the infectious agents deliver the nucleic acids to a cell in the subject, and/or permit expression of the encoded variant polypeptides in the cell. Also provided are nucleic acids that are used to generate, produce or modify such infectious agents. For example, in some embodiments, provided are vectors and/or plasmids that contain nucleic acids encoding the variant immunomodulatory polypeptides, for generation of the infectious agents, delivery to the cells in a subject and/or expression of the variant immunomodulatory polypeptides in the cells in the subject.

In some embodiments, the provided nucleic acids are recombinant viral or bacterial vectors containing nucleic acid sequences encoding the variant immunomodulatory polypeptides. In some embodiments, the recombinant vectors can be used to produce an infectious agent that contains nucleic acid sequences encoding the variant immunomodulatory polypeptides and/or to be delivered to a target cell in the subject for expression by the target cell. In some embodiments, the recombinant vector is an expression vector. In some embodiments, the recombinant vector includes appropriate sequences necessary for generation and/or production of the infectious agent and expression in the target cell.

In some embodiments, the recombinant vector is a plasmid or cosmid. Plasmid or cosmid containing nucleic acid sequencess encoding the variant immunomodulatory polypeptides, as described herein, is readily constructed using standard techniques well known in the art. For generation of the infectious agent, the vector or genome can be constructed in a plasmid form that can then be transfected into a packaging or producer cell line or a host bacterium. The recombinant vectors can be generated using any of the recombinant techniques known in the art. In some embodiments, the vectors can include a prokaryotic origin of replication and/or a gene whose expression confers a detectable or selectable marker such as a drug resistance for propagation and/or selection in prokaryotic systems.

In some embodiments, the recombinant vector is a viral vector. Exemplary recombinant viral vectors include a lentiviral vector genome, poxvirus vector genome, vaccinia virus vector genome, adenovirus vector genome, adenovirus-associated virus vector genome, herpes virus vector genome, and alpha virus vector genome. Viral vectors can be live, attenuated, replication conditional or replication deficient, non-pathogenic (defective), replication competent viral vector, and/or is modified to express a heterologous gene product, e.g., the variant immunomodulatory polypeptides provided herein. Vectors for generation of viruses also can be modified to alter attenuation of the virus, which includes any method of increasing or decreasing the transcriptional or translational load.

Exemplary viral vectors that can be used include modified vaccinia virus vectors (see, e.g., Guerra et al., J. Virol. 80:985-98 (2006); Tartaglia et al., AIDS Research and Human Retroviruses 8: 1445-47 (1992); Gheradi et al., J. Gen. Virol. 86:2925-36 (2005); Mayr et al., Infection 3:6-14 (1975); Hu et al., J. Virol. 75: 10300-308 (2001); U.S. Pat. Nos. 5,698,530, 6,998,252, 5,443,964, 7,247,615 and 7,368, 116); adenovirus vector or adenovirus-associated virus vectors (see., e.g., Molin et al., J. Virol. 72:8358-61 (1998); Narumi et al., Am J. Respir. Cell Mol. Biol. 19:936-41 (1998); Mercier et al., Proc. Natl. Acad. Sci. USA 101:6188-93 (2004); U.S. Pat. Nos. 6,143,290; 6,596,535; 6,855,317; 6,936,257; 7,125,717; 7,378,087; 7,550,296); retroviral vectors including those based upon murine leukemia virus (MuLV), gibbon ape leukemia virus (GaLV), ecotropic retroviruses, simian immunodeficiency virus (SIV), human immunodeficiency virus (HIV), and combinations (see, e.g., Buchscher et al., J. Virol. 66:2731-39 (1992); Johann et al., J. Virol. 66: 1635-40 (1992); Sommerfelt et al., Virology 176:58-59 (1990); Wilson et al., J. Virol. 63:2374-78 (1989); Miller et al., J. Virol. 65:2220-24 (1991); Miller et al., Mol. Cell Biol. 10:4239 (1990); Kolberg, NIH Res. 4:43 1992; Cornetta et al., Hum. Gene Ther. 2:215 (1991)); lentiviral vectors including those based upon Human Immunodeficiency Virus (HIV-1), HIV-2, feline immunodeficiency virus (FIV), equine infectious anemia virus, Simian Immunodeficiency Virus (SIV), and maedi/visna virus (see, e.g., Pfeifer et al., Annu. Rev. Genomics Hum. Genet. 2: 177-211 (2001); Zufferey et al., J. Virol. 72: 9873, 1998; Miyoshi et al., J. Virol. 72:8150, 1998; Philpott and Thrasher, Human Gene Therapy 18:8, 2007; Engelman et al., J. Virol. 69: 2729, 1995; Nightingale et al., Mol. Therapy, 13: 1121, 2006; Brown et al., J. Virol. 73:9011 (1999); WO 2009/076524; WO 2012/141984; WO 2016/011083; McWilliams et al., J. Virol. 77: 11150, 2003; Powell et al., J. Virol. 70:5288, 1996) or any, variants thereof, and/or vectors that can be used to generate any of the viruses described above. In some embodiments, the recombinant vector can include regulatory sequences, such as promoter or enhancer sequences, that can regulate the expression of the viral genome, such as in the case for RNA viruses, in the packaging cell line (see, e.g., U.S. Pat. Nos. 5,385,839 and 5,168,062).

In some embodiments, the recombinant vector is an expression vector, e.g., an expression vector that permits expression of the encoded gene product when delivered into the target cell, e.g., a cell in the subject, e.g., a tumor cell, an immune cell and/or an APC. In some embodiments, the recombinant expression vectors contained in the infectious agent are capable of expressing the immunomodulatory proteins in the target cell in the subject, under conditions suited to expression of the protein.

In some aspects, nucleic acids or an expression vector comprises a nucleic acid sequence that encodes the immunomodulatory protein operatively linked to appropriate expression control sequences. Methods of affecting this operative linking, either before or after the nucleic acid sequence encoding the immunomodulatory protein is inserted into the vector, are well known. Expression control sequences include promoters, activators, enhancers, operators, ribosomal binding sites, start signals, stop signals, cap signals, polyadenylation signals, and other signals involved with the control of transcription or translation. The promoter can be operably linked to the portion of the nucleic acid sequence encoding the immunomodulatory protein. In some embodiments, the promotor is a constitutively active promotor in the target cell (such as a tissue-specific constitutively active promotor or other constitutive promotor). For example, the recombinant expression vector may also include, lymphoid tissue-specific transcriptional regulatory elements (TRE) such as a B lymphocyte, T lymphocyte, or dendritic cell specific TRE. Lymphoid tissue specific TRE are known in the art (see, e.g., Thompson et al., Mol. Cell. Biol. 12:1043-53 (1992); Todd et al., J. Exp. Med. 177: 1663-74 (1993); Penix et al., J. Exp. Med. 178:1483-96 (1993)). In some embodiments, the promotor is an inducible promotor, which may be responsive to an inducing agent (such as a T cell activation signal). In some embodiments, nucleic acids delivered to the target cell in the subject, e.g., tumor cell, immune cell and/or APC, can be operably linked to any of the regulatory elements described above.

In some embodiments, the vector is a bacterial vector, e.g., a bacterial plasmid or cosmid. In some embodiments, the bacterial vector is delivered to the target cell, e.g., tumor cells, immune cells and/or APCs, via bacterial-mediated transfer of plasmid DNA to mammalian cells (also referred to as "bactofection"). In some embodiments, the delivered bacterial vector also contains appropriate expression control sequences for expression in the target cells, such as a promoter sequence and/or enhancer sequences, or any regulatory or control sequences described above. In some embodiments, the bacterial vector contains appropriate expression control sequences for expression and/or secretion of the encoded variant polypeptides in the infectious agent, e.g., the bacterium.

In some embodiments, polypeptides provided herein can also be made by synthetic methods. Solid phase synthesis is the preferred technique of making individual peptides since it is the most cost-effective method of making small peptides. For example, well known solid phase synthesis techniques include the use of protecting groups, linkers, and solid phase supports, as well as specific protection and deprotection reaction conditions, linker cleavage conditions, use of scavengers, and other aspects of solid phase peptide synthesis. Peptides can then be assembled into the polypeptides as provided herein.

IV. METHODS OF ASSESSING ACTIVITY IMMUNE MODULATION OF VARIANT CD80 POLYPEPTIDES AND IMMUNOMODULATORY PROTEINS

In some embodiments, the variant CD80 polypeptides provided herein (e.g. full-length and/or specific binding fragments or conjugates, stack constructs or fusion thereof) exhibit immunomodulatory activity to modulate T cell activation. In some embodiments, CD80 polypeptides modulate IFN-gamma expression in a primary T cell assay relative to a wild-type or unmodified CD80 control. In some cases, modulation of IFN-gamma expression can increase or decrease IFN-gamma expression relative to the control. Assays to determine specific binding and IFN-gamma expression are well-known in the art and include the MLR (mixed lymphocyte reaction) assays measuring interferon-gamma cytokine levels in culture supernatants (Wang et al., Cancer Immunol Res. 2014 September: 2(9):846-56), SEB (staphylococcal enterotoxin B) T cell stimulation assay (Wang et al., Cancer Immunol Res. 2014 September: 2(9): 846-56), and anti-CD3 T cell stimulation assays (Li and Kurlander, J Transl Med. 2010: 8: 104).

In some embodiments, a variant CD80 polypeptide can in some embodiments increase or, in alternative embodiments, decrease IFN-gamma (interferon-gamma) expression in a primary T-cell assay relative to a wild-type CD80 control. In some embodiments of the provided polypeptides containing a soluble variant CD80 sequence, the polypeptide can increase IFN-gamma expression and, in alternative embodiments, decrease IFN-gamma expression in a primary T-cell assay relative to a wild-type CD80 control. In some embodiments of the provided polypeptides containing multiple variant CD80 sequences, the polypeptide can increase IFN-gamma expression and, in alternative embodiments, decrease IFN-gamma expression in a primary T-cell assay relative to a wild-type CD80 control.

Those of skill will recognize that the format of the primary T-cell assay used to determine an increase in IFN-gamma expression can differ from that employed to assay for a decrease in IFN-gamma expression. In assaying for the ability of a variant CD80 to decrease IFN-gamma expression in a primary T-cell assay, a Mixed Lymphocyte Reaction (MLR) assay can be used as described in Example 6. In some cases, a soluble form of a variant CD80 can be employed to determine the ability of the variant CD80 to antagonize and thereby decrease the IFN-gamma expression in a MLR as likewise described in Example 6.

Alternatively, in assaying for the ability of a variant CD80 to increase IFN-gamma expression in a primary T-cell assay, a co-immobilization assay can be used as described in Example 6. In a co-immobilization assay, a TCR signal, provided in some embodiments by anti-CD3 antibody, is used in conjunction with a co-immobilized variant CD80 to determine the ability to increase IFN-gamma expression relative to a CD80 control. In some cases, a soluble form of a variant CD80 that is multimerized to a degree to provide multivalent binding can be employed to determine the ability of the variant CD80 to agonize and thereby increase the IFN-gamma expression in a MLR as likewise described in Example 6.

Use of proper controls is known to those of skill in the art, however, in the aforementioned embodiments, the control typically involves use of the unmodified CD80, such as a wild-type of native CD80 isoform from the same mammalian species from which the variant CD80 was derived or developed. Irrespective of whether the binding affinity to either one or both of ICOS and CD28 is increased or decreased, a variant CD80 in some embodiments will increase IFN-gamma expression and, in alternative embodiments, decrease IFN-gamma expression in a primary T-cell assay relative to a wild-type CD80 control.

In some embodiments, a variant CD80 increases IFN-gamma expression (i.e., protein expression) relative to a wild-type or unmodified CD80 control by at least: 5%, 10%, 20%, 30%, 40%, 50%, 60%, 70%, 80%, 90%, or higher. In other embodiments, a variant CD80 decreases IFN-gamma expression (i.e. protein expression) relative to a wild-type or unmodified CD80 control by at least: 5%, 10%, 20%, 30%, 40%, 50%, 60%, 70%, 80%, 90%, or higher. In some embodiments, the wild-type CD80 control is murine CD80, such as would typically be used for a variant CD80 altered in sequence from that of a wild-type murine CD80 sequence. In some embodiments, the wild-type CD80 control is human CD80, such as would typically be used for a variant CD80 altered in sequence from that of a wild-type human CD80 sequence such as an CD80 sequence comprising the sequence of amino acids of SEQ ID NO:28, SEQ ID NO: 152, or SEQ ID NO:372.

V. PHARMACEUTICAL FORMULATIONS

Provided herein are compositions containing any of the variant CD80 polypeptides, immunomodulatory proteins, conjugates, engineered cells or infectious agents described herein. The pharmaceutical composition can further comprise a pharmaceutically acceptable excipient. For example, the pharmaceutical composition can contain one or more excipients for modifying, maintaining or preserving, for example, the pH, osmolarity, viscosity, clarity, color, isotonicity, odor, sterility, stability, rate of dissolution or release, adsorption, or penetration of the composition. In some aspects, a skilled artisan understands that a pharmaceutical composition containing cells may differ from a pharmaceutical composition containing a protein.

In some embodiments, the pharmaceutical composition is a solid, such as a powder, capsule, or tablet. For example, the components of the pharmaceutical composition can be lyophilized. In some embodiments, the solid pharmaceutical composition is reconstituted or dissolved in a liquid prior to administration.

In some embodiments, the pharmaceutical composition is a liquid, for example variant CD80 polypeptides dissolved in an aqueous solution (such as physiological saline or Ringer's solution). In some embodiments, the pH of the pharmaceutical composition is between about 4.0 and about 8.5 (such as between about 4.0 and about 5.0, between about 4.5 and about 5.5, between about 5.0 and about 6.0, between about 5.5 and about 6.5, between about 6.0 and about 7.0, between about 6.5 and about 7.5, between about 7.0 and about 8.0, or between about 7.5 and about 8.5).

In some embodiments, the pharmaceutical composition comprises a pharmaceutically-acceptable excipient, for example a filler, binder, coating, preservative, lubricant, flavoring agent, sweetening agent, coloring agent, a solvent, a buffering agent, a chelating agent, or stabilizer. Examples of pharmaceutically-acceptable fillers include cellulose, dibasic calcium phosphate, calcium carbonate, microcrystalline cellulose, sucrose, lactose, glucose, mannitol, sorbitol, maltol, pregelatinized starch, corn starch, or potato starch. Examples of pharmaceutically-acceptable binders include polyvinylpyrrolidone, starch, lactose, xylitol, sorbitol, maltitol, gelatin, sucrose, polyethylene glycol, methyl cellulose, or cellulose. Examples of pharmaceutically-acceptable coatings include hydroxypropyl methylcellulose (HPMC), shellac, corn protein zein, or gelatin. Examples of pharmaceutically-acceptable disintegrants include polyvinylpyrrolidone, carboxymethyl cellulose, or sodium starch glycolate. Examples of pharmaceutically-acceptable lubricants include polyethylene glycol, magnesium stearate, or stearic acid. Examples of pharmaceutically-acceptable preservatives include methyl parabens, ethyl parabens, propyl paraben, benzoic acid, or sorbic acid. Examples of pharmaceutically-acceptable sweetening agents include sucrose, saccharine, aspartame, or sorbitol. Examples of pharmaceutically-acceptable buffering agents include carbonates, citrates, gluconates, acetates, phosphates, or tartrates.

In some embodiments, the pharmaceutical composition further comprises an agent for the controlled or sustained release of the product, such as injectable microspheres, bio-erodible particles, polymeric compounds (polylactic acid, polyglycolic acid), beads, or liposomes.

In some embodiments, the pharmaceutical composition is sterile. Sterilization may be accomplished by filtration through sterile filtration membranes or radiation. Where the composition is lyophilized, sterilization using this method may be conducted either prior to or following lyophilization and reconstitution. The composition for parenteral administration may be stored in lyophilized form or in solution. In addition, parenteral compositions generally are placed into a container having a sterile access port, for example, an intravenous solution bag or vial having a stopper pierceable by a hypodermic injection needle.

In some embodiments, provided are pharmaceutical compositions containing the transmembrane immunomodulatory proteins, including engineered cells expressing such transmembrane immunomodulatory proteins. In some embodiments, the pharmaceutical compositions and formulations include one or more optional pharmaceutically acceptable carrier or excipient. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are preferably formulated for intravenous administration.

In some embodiments, the pharmaceutical composition contains infectious agents containing nucleic acid sequences encoding the immunomodulatory variant polypeptides. In some embodiments, the pharmaceutical composition contains a dose of infectious agents suitable for administration to a subject that is suitable for treatment. In some embodiments, the pharmaceutical composition contains an infectious agent that is a virus, at a single or multiple dosage amount, of between about between or between about $1\times10^5$ and about $1\times10^{12}$ plaque-forming units (pfu), $1\times10^6$ and $1\times10^{10}$ pfu, or $1\times10^7$ and $1\times10^{10}$ pfu, each inclusive, such as at least or at least about or at about $1\times10^6$, $1\times10^7$, $1\times10^8$, $1\times10^9$, $2\times10^9$, $3\times10^9$, $4\times10^9$, $5\times10^9$ pfu or about $1\times10^{10}$ pfu. In some embodiments, the pharmaceutical composition can contain a virus concentration of from or from about $10^5$ to about $10^{10}$ pfu/mL, for example, $5\times10^6$ to $5\times10^9$ or $1\times10^7$ to $1\times10^9$ pfu/mL, such as at least or at least about or at about $10^6$ pfu/mL, $10^7$ pfu/mL, $10^8$ pfu/mL or $10^9$ pfu/mL. In some embodiments, the pharmaceutical composition contains an infectious agent that is a bacterium, at a single or multiple dosage amount, of between about between or between about $1\times10^3$ and about $1\times10^9$ colony-forming units (cfu), $1\times10^4$ and $1\times10^9$ cfu, or $1\times10^5$ and $1\times10^7$ cfu, each inclusive, such as at least or at least about or at about $1\times10^4$, $1\times10^5$, $1\times10^6$, $1\times10^7$, $1\times10^8$ or $1\times10^9$ cfu. In some embodiments, the pharmaceutical composition can contain a bacterial concentration of from or from about $10^3$ to about $10^8$ cfu/mL, for example, $5\times10^5$ to $5\times10^7$ or $1\times10^6$ to $1\times10^7$ cfu/mL, such as at least or at least about or at about $10^5$ cfu/mL, $10^6$ cfu/mL, $10^7$ cfu/mL or $10^8$ cfu/mL Such a formulation may, for example, be in a form suitable for intravenous infusion. A pharmaceutically acceptable carrier may be a pharmaceutically acceptable material, composition, or vehicle that is involved in carrying or transporting cells of interest from one tissue, organ, or portion of the body to another tissue, organ, or portion of the body. For example, the carrier may be a liquid or solid filler, diluent, excipient, solvent, or encapsulating material, or some combination thereof. Each component of the carrier must be "pharmaceutically acceptable" in that it must be compatible with the other ingredients of the formulation. It also must be suitable for contact with any tissue, organ, or portion of the body that it may encounter, meaning that it must not carry a risk of toxicity, irritation, allergic response, immunogenicity, or any other complication that excessively outweighs its therapeutic benefits.

In some embodiments, the pharmaceutical composition is administered to a subject. Generally, dosages and routes of administration of the pharmaceutical composition are determined according to the size and condition of the subject, according to standard pharmaceutical practice. For example, the therapeutically effective dose can be estimated initially either in cell culture assays or in animal models such as mice, rats, rabbits, dogs, pigs, or monkeys. An animal model may also be used to determine the appropriate concentration range and route of administration. Such information can then be used to determine useful doses and routes for administration in humans. The exact dosage will be determined in light of factors related to the subject requiring treatment. Dosage and administration are adjusted to provide sufficient levels of the active compound or to maintain the desired effect. Factors that may be taken into account include the severity of the disease state, the general health of the subject, the age, weight, and gender of the subject, time and frequency of administration, drug combination(s), reaction sensitivities, and response to therapy.

Long-acting pharmaceutical compositions may be administered every 3 to 4 days, every week, or biweekly depending on the half-life and clearance rate of the particular formulation. The frequency of dosing will depend upon the pharmacokinetic parameters of the molecule in the formulation used. Typically, a composition is administered until a dosage is reached that achieves the desired effect. The composition may therefore be administered as a single dose, or as multiple doses (at the same or different concentrations/dosages) over time, or as a continuous infusion. Further refinement of the appropriate dosage is routinely made. Appropriate dosages may be ascertained through use of appropriate dose-response data. A number of biomarkers or physiological markers for therapeutic effect can be monitored including T cell activation or proliferation, cytokine synthesis or production (e.g., production of TNF-α, IFN-γ, IL-2), induction of various activation markers (e.g., CD25, IL-2 receptor), inflammation, joint swelling or tenderness, serum level of C-reactive protein, anti-collagen antibody production, and/or T cell-dependent antibody response(s).

In some embodiments, the pharmaceutical composition is administered to a subject through any route, including orally, transdermally, by inhalation, intravenously, intra-arterially, intramuscularly, direct application to a wound site, application to a surgical site, intraperitoneally, by suppository, subcutaneously, intradermally, transcutaneously, by nebulization, intrapleurally, intraventricularly, intra-articularly, intraocularly, or intraspinally.

In some embodiments, the dosage of the pharmaceutical composition is a single dose or a repeated dose. In some embodiments, the doses are given to a subject once per day, twice per day, three times per day, or four or more times per day. In some embodiments, about 1 or more (such as about 2 or more, about 3 or more, about 4 or more, about 5 or more, about 6 or more, or about 7 or more) doses are given in a week. In some embodiments, multiple doses are given over the course of days, weeks, months, or years. In some embodiments, a course of treatment is about 1 or more doses (such as about 2 or more does, about 3 or more doses, about 4 or more doses, about 5 or more doses, about 7 or more doses, about 10 or more doses, about 15 or more doses, about 25 or more doses, about 40 or more doses, about 50 or more doses, or about 100 or more doses).

In some embodiments, an administered dose of the pharmaceutical composition is about 1 μg of protein per kg subject body mass or more (such as about 2 μg of protein per kg subject body mass or more, about 5 μg of protein per kg subject body mass or more, about 10 μg of protein per kg subject body mass or more, about 25 μg of protein per kg subject body mass or more, about 50 μg of protein per kg subject body mass or more, about 100 μg of protein per kg subject body mass or more, about 250 μg of protein per kg subject body mass or more, about 500 μg of protein per kg subject body mass or more, about 1 mg of protein per kg subject body mass or more, about 2 mg of protein per kg subject body mass or more, or about 5 mg of protein per kg subject body mass or more).

In some embodiments, a therapeutic amount of a cell composition is administered. Typically, precise amount of the compositions of the present invention to be administered can be determined by a physician with consideration of individual differences in age, weight, tumor size, extent of infection or metastasis, and condition of the patient (subject). It can generally be stated that a pharmaceutical composition comprising engineered cells, e.g. T cells, as described herein may be administered at a dosage of 104 to 109 cells/kg body weight, such as 105 to 106 cells/kg body weight, including all integer values within those ranges. Engineered cell compositions, such as T cell compositions, may also be administered multiple times at these dosages.

The cells can be administered by using infusion techniques that are commonly known in immunotherapy (see, e.g., Rosenberg et al, New Eng. J. of Med. 319: 1676, 1988). The optimal dosage and treatment regime for a particular patient can readily be determined by one skilled in the art of medicine by monitoring the patient for signs of disease and adjusting the treatment accordingly.

A variety of means are known for determining if administration of a therapeutic composition of the invention sufficiently modulates immunological activity by eliminating, sequestering, or inactivating immune cells mediating or capable of mediating an undesired immune response; inducing, generating, or turning on immune cells that mediate or are capable of mediating a protective immune response; changing the physical or functional properties of immune cells; or a combination of these effects. Examples of measurements of the modulation of immunological activity include, but are not limited to, examination of the presence or absence of immune cell populations (using flow cytometry, immunohistochemistry, histology, electron microscopy, polymerase chain reaction (PCR)); measurement of the functional capacity of immune cells including ability or resistance to proliferate or divide in response to a signal (such as using T-cell proliferation assays and pepscan analysis based on 3H-thymidine incorporation following stimulation with anti-CD3 antibody, anti-T-cell receptor antibody, anti-CD28 antibody, calcium ionophores, PMA (phorbol 12-myristate 13-acetate) antigen presenting cells loaded with a peptide or protein antigen; B cell proliferation assays); measurement of the ability to kill or lyse other cells (such as cytotoxic T cell assays); measurements of the cytokines, chemokines, cell surface molecules, antibodies and other products of the cells (e.g., by flow cytometry, enzyme-linked immunosorbent assays, Western blot analysis, protein microarray analysis, immunoprecipitation analysis); measurement of biochemical markers of activation of immune cells or signaling pathways within immune cells (e.g., Western blot and immunoprecipitation analysis of tyrosine, serine or threonine phosphorylation, polypeptide cleavage, and formation or dissociation of protein complexes; protein array analysis; DNA transcriptional, profiling using DNA arrays or subtractive hybridization); measurements of cell death by apoptosis, necrosis, or other mechanisms (e.g., annexin V staining, TUNEL assays, gel electrophoresis to measure DNA laddering, histology; fluorogenic caspase assays, Western blot analysis of caspase substrates); measurement of the genes, proteins, and other molecules produced by immune cells (e.g., Northern blot analysis, polymerase chain reaction, DNA microarrays, protein microarrays, 2-dimensional gel electrophoresis, Western blot analysis, enzyme linked immunosorbent assays, flow cytometry); and measurement of clinical symptoms or outcomes such as improvement of autoimmune, neurodegenerative, and other diseases involving self-proteins or self-polypeptides (clinical scores, requirements for use of additional therapies, functional status, imaging studies) for example, by measuring relapse rate or disease severity (using clinical scores known to the ordinarily skilled artisan) in the case of multiple sclerosis, measuring blood glucose in the case of type I diabetes, or joint inflammation in the case of rheumatoid arthritis.

VI. ARTICLES OF MANUFACTURE AND KITS

Also provided herein are articles of manufacture comprising the pharmaceutical compositions described herein in suitable packaging. Suitable packaging for compositions (such as ophthalmic compositions) described herein are known in the art, and include, for example, vials (such as sealed vials), vessels, ampules, bottles, jars, flexible packaging (e.g., sealed Mylar or plastic bags), and the like. These articles of manufacture may further be sterilized and/or sealed.

Further provided are kits comprising the pharmaceutical compositions (or articles of manufacture) described herein, which may further comprise instruction(s) on methods of using the composition, such as uses described herein. The kits described herein may also include other materials desirable from a commercial and user standpoint, including other buffers, diluents, filters, needles, syringes, and package inserts with instructions for performing any methods described herein.

VII. THERAPEUTIC APPLICATIONS

The pharmaceutical compositions described herein (including pharmaceutical composition comprising the variant CD80 polypeptides, the immunomodulatory proteins, the conjugates, and the engineered cells described herein) can be used in a variety of therapeutic applications, such as the treatment of a disease. For example, in some embodiments the pharmaceutical composition is used to treat inflammatory or autoimmune disorders, cancer, organ transplantation, viral infections, and/or bacterial infections in a mammal. The pharmaceutical composition can modulate (e.g. increase or decrease) an immune response to treat the disease. In some embodiments, the provided methods are applicable to therapeutic administration of variant CD80 polypeptides, the immunomodulatory proteins, the conjugates, the engineered cells and infectious agents described herein. It is within the level of a skilled artisan, in view of the provided disclosure, to choose a format for the indication depending on the type of modulation of the immune response, e.g. increase or decrease that is desired.

In some embodiments, a pharmaceutical composition provided herein that stimulates the immune response is administered, which can be useful, for example, in the treatment of cancer, viral infections, or bacterial infections. In some embodiments, the pharmaceutical composition contains a variant CD80 polypeptide in a format that exhibits agonist activity of its cognate binding partner CD28 and/or that stimulates or initiates costimulatory signaling via CD28. Exemplary formats of a CD80 polypeptide for use in connection with such therapeutic applications include, for example, an immunomodulatory protein or "stack" of a variant CD80 polypeptide and an IgSF domain or variant thereof that binds to a tumor antigen (e.g. Nkp30 or affinity-modified variant) (also called a "tumor-localizing IgSF domain), a conjugate containing a variant CD80 polypeptide linked to a tumor-targeting moiety (also called a tumor-localizing moiety), an engineered cell expressing a transmembrane immunomodulatory protein, or an infectious agent comprising a nucleic acid molecule encoding a transmembrane immunomodulatory protein, such as for expression of the transmembrane immunomodulatory protein in an infected cell (e.g. tumor cell or APC, e.g. dendritic cell).

In some embodiments, the pharmaceutical composition can be used to inhibit growth of mammalian cancer cells (such as human cancer cells). A method of treating cancer can include administering an effective amount of any of the pharmaceutical compositions described herein to a subject with cancer. The effective amount of the pharmaceutical composition can be administered to inhibit, halt, or reverse progression of cancers.

The cancers that can be treated by the pharmaceutical compositions and the treatment methods described herein include, but are not limited to, melanoma, bladder cancer, hematological malignancies (leukemia, lymphoma, myeloma), liver cancer, brain cancer, renal cancer, breast cancer, pancreatic cancer (adenocarcinoma), colorectal cancer, lung cancer (small cell lung cancer and non-small-cell lung cancer), spleen cancer, cancer of the thymus or blood cells (i.e., leukemia), prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer. In some embodiments, the cancer is Ewing's sarcoma. In some embodiments, the cancer is selected from melanoma, lung cancer, bladder cancer, and a hematological malignancy. In some embodiments, the cancer is a lymphoma, lymphoid leukemia, myeloid leukemia, cervical cancer, neuroblastoma, or multiple myeloma.

Human cancer cells can be treated in vivo, or ex vivo. In ex vivo treatment of a human patient, tissue or fluids containing cancer cells are treated outside the body and then the tissue or fluids are reintroduced back into the patient. In some embodiments, the cancer is treated in a human patient in vivo by administration of the therapeutic composition into the patient.

In some embodiments, the pharmaceutical composition is administered as a monotherapy (i.e., as a single agent) or as a combination therapy (i.e., in combination with one or more additional anticancer agents, such as a chemotherapeutic drug, a cancer vaccine, or an immune checkpoint inhibitor. In some embodiments, the pharmaceutical composition can also be administered with radiation therapy.

In some embodiments, the pharmaceutical composition suppresses an immune response, which can be useful in the treatment of inflammatory or autoimmune disorders, or organ transplantation. In some embodiments, the pharmaceutical composition contains a variant CD80 polypeptide in a format that exhibits antagonist activity of its cognate binding partner CD28 and/or that blocks or inhibits costimulatory signaling via CD28. Exemplary formats of CD80 polypeptide for use in connection with such therapeutic applications include, for example, a variant CD80 polypeptide that is soluble (e.g. variant CD80-Fc fusion protein), an immunomodulatory protein or "stack" of a variant CD80 polypeptide and another IgSF domain, including soluble forms thereof that are Fc fusions, an engineered cell expressing a secretable immunomodulatory protein, or an infectious agent comprising a nucleic acid molecule encoding a secretable immunomodulatory protein, such as for expression and secretion of the secretable immunomodulatory protein in an infected cell (e.g. tumor cell or APC, e.g. dendritic cell).

In some embodiments, the inflammatory or autoimmune disorder is Antineutrophil cytoplasmic antibodies (ANCA)-associated vasculitis, a vasculitis, an autoimmune skin disease, transplantation, a Rheumatic disease, an inflammatory gastrointestinal disease, an inflammatory eye disease, an inflammatory neurological disease, an inflammatory pulmonary disease, an inflammatory endocrine disease, or an autoimmune hematological disease.

In some embodiments, the inflammatory and autoimmune disorders that can be treated by the pharmaceutical composition described herein is Addison's Disease, allergies, alopecia areata, Alzheimer's, anti-neutrophil cytoplasmic antibodies (ANCA)-associated vasculitis, ankylosing spondylitis, antiphospholipid syndrome (Hughes Syndrome), asthma, atherosclerosis, rheumatoid arthritis, autoimmune hemolytic anemia, autoimmune hepatitis, autoimmune inner ear disease, autoimmune lymphoproliferative syndrome, autoimmune myocarditis, autoimmune oophoritis, autoimmune orchitis, azoospermia, Behcet's Disease, Berger's Disease, bullous pemphigoid, cardiomyopathy, cardiovascular disease, celiac Sprue/coeliac disease, chronic fatigue immune dysfunction syndrome (CFIDS), chronic idiopathic polyneuritis, chronic inflammatory demyelinating, polyradicalneuropathy (CIPD), chronic relapsing polyneuropathy (Guillain-Barré syndrome), Churg-Strauss Syndrome (CSS), cicatricial pemphigoid, cold agglutinin disease (CAD), COPD (chronic obstructive pulmonary disease), CREST syndrome, Crohn's disease, dermatitis, herpetiformus, dermatomyositis, diabetes, discoid lupus, eczema, epidermolysis bullosa acquisita, essential mixed cryoglobulinemia, Evan's Syndrome, exopthalmos, fibromyalgia, Goodpasture's Syndrome, Graves' Disease, Hashimoto's thyroiditis, idiopathic pulmonary fibrosis, idiopathic thrombocytopenia purpura (ITP), IgA nephropathy, immunoproliferative disease or disorder, inflammatory bowel disease (IBD), interstitial lung disease, juvenile arthritis, juvenile idiopathic arthritis (JIA), Kawasaki's Disease, Lambert-Eaton Myasthenic Syndrome, lichen planus, lupus nephritis, lymphoscytic lypophisitis, Ménière's Disease, Miller Fish Syndrome/acute disseminated encephalomyeloradiculopathy, mixed connective tissue disease, multiple sclerosis (MS), muscular rheumatism, myalgic encephalomyelitis (ME), myasthenia gravis, ocular inflammation, pemphigus foliaceus, pemphigus vulgaris, pernicious anaemia, polyarteritis nodosa, polychondritis, polyglandular syndromes (Whitaker's syndrome), polymyalgia rheumatica, polymyositis, primary agammaglobulinemia, primary biliary cirrhosis/autoimmune cholangiopathy, psoriasis, psoriatic arthritis, Raynaud's Phenomenon, Reiter's Syndrome/reactive arthritis, restenosis, rheumatic fever, rheumatic disease, sarcoidosis, Schmidt's syndrome, scleroderma, Sjörgen's Syndrome, stiff-man syndrome, systemic lupus erythematosus (SLE), systemic scleroderma, Takayasu arteritis, temporal arteritis/giant cell arteritis, thyroiditis, Type 1 diabetes, ulcerative colitis, uveitis, vasculitis, vitiligo, interstitial bowel disease or Wegener's Granulomatosis. In some embodiments, the inflammatory or autoimmune disorder is selected from interstitial bowel disease, transplant, Crohn's disease, ulcerative colitis, multiple sclerosis, asthma, rheumatoid arthritis, and psoriasis.

In some embodiments, the pharmaceutical composition is administered to modulate an autoimmune condition. For example, suppressing an immune response can be beneficial in methods for inhibiting rejection of a tissue, cell, or organ transplant from a donor by a recipient. Accordingly, in some embodiments, the pharmaceutical compositions described herein are used to limit or prevent graft-related or transplant related diseases or disorders, such as graft versus host disease (GVHD). In some embodiments, the pharmaceutical compositions are used to suppress autoimmune rejection of transplanted or grafted bone marrow, organs, skin, muscle, neurons, islets, or parenchymal cells.

Pharmaceutical compositions comprising engineered cells and the methods described herein can be used in adoptive cell transfer applications. In some embodiments, cell compositions comprising engineered cells can be used in associated methods to, for example, modulate immunological activity in an immunotherapy approach to the treatment of, for example, a mammalian cancer or, in other embodiments the treatment of autoimmune disorders. The methods employed generally comprise a method of contacting a TIP of the present invention with a mammalian cell under conditions that are permissive to specific binding of the affinity modified IgSF domain and modulation of the immunological activity of the mammalian cell. In some embodiments, immune cells (such as tumor infiltrating lymphocytes (TILs), T-cells (including CD8+ or CD4+ T-cells), or APCs) are engineered to express as a membrane protein and/or as a soluble variant CD80 polypeptide, immunomodulatory protein, or conjugate as described herein. The engineered cells can then be contact a mammalian cell, such as an APC, a second lymphocyte or tumor cell in which modulation of immunological activity is desired and under conditions that are permissive of specific binding of the affinity modified IgSF domain to a counter-structure on the mammalian cell such that immunological activity can be modulated in the mammalian cell. Cells can be contacted in vivo or ex vivo.

In some embodiments, the engineered cells are autologous cells. In other embodiments, the cells are allogeneic. In some embodiments, the cells are autologous engineered cells reinfused into the mammal from which it was isolated. In some embodiments, the cells are allogenic engineered cells infused into the mammal. In some embodiments, the cells are harvested from a patient's blood or tumor, engineered to express a polypeptide (such as the variant CD80 polypeptide, immunomodulatory protein, or conjugate as described herein), expanded in an in vitro culture system (for example, by stimulating the cells), and reinfused into the patient to mediate tumor destruction. In some embodiments, the methods is conducted by adoptive cell transfer wherein cells expressing the TIP (e.g., a T-cell) are infused back into the patient. In some embodiments, the therapeutic compositions and methods of the invention are used in the treatment of a mammalian patient of cancers such as lymphoma, lymphoid leukemia, myeloid leukemia, cervical cancer, neuroblastoma, or multiple myeloma.

VIII. EXEMPLARY EMBODIMENTS

Among the provided embodiments are: 1. A variant CD80 polypeptide, comprising an IgV domain or a specific binding fragment thereof, an IgC domain or a specific binding fragment thereof, or both, wherein the variant CD80 polypeptide comprises one or more amino acid modifications in an unmodified CD80 or specific binding fragment thereof, corresponding to position(s) 4, 9, 10, 11, 12, 13, 14, 15, 16, 17, 18, 20, 21, 22, 24, 25, 27, 28, 29, 30, 31, 33, 36, 37, 38, 40, 41, 42, 43, 44, 47, 48, 50, 52, 53, 54, 59, 60, 61, 62, 63, 64, 65, 66, 67, 68, 69, 70, 72, 74, 76, 77, 80, 81, 83, 85, 86, 87, 88, 89, 90, 91, 92, 93, 94, 95, 96, 97, 99, 102, 103, 104, 107, 108, 109, 110, 114, 115, 116, 117, 118, 120, 121, 122, 126, 127, 128, 129, 130, 133, 137, 140, 142, 143, 144, 148, 149, 152, 154, 160, 162, 164, 168, 169, 174, 175, 177, 178, 183, 185, 188, 190, 192, 193, or 199 with reference to numbering of SEQ ID NO: 28.

2. The variant CD80 polypeptide of embodiment 1, wherein the one or more amino acid modifications comprises one or more amino acid substitution, insertion or deletion.

3. The variant CD80 polypeptide of embodiment 1 or embodiment 2, wherein the unmodified CD80 is a mammalian CD80.

4. The variant CD80 polypeptide of any of embodiments 1-3, wherein the CD80 is a human CD80.

5. The variant CD80 polypeptide of any of embodiments 1-4, wherein the variant CD80 polypeptide comprises:

the IgV domain or a specific binding fragment thereof; and the IgC domain or a specific binding fragment thereof.

6. The variant CD80 polypeptide of any of embodiments 1-5, wherein the unmodified CD80 comprises (i) the sequence of amino acids set forth in SEQ ID NO:28, (ii) a sequence of amino acids that has at least 95% sequence identity to SEQ ID NO:28; or (iii) is a portion thereof comprising an IgV domain or IgC domain or specific binding fragments thereof.

7. The variant CD80 polypeptide of any of embodiments 1-6, wherein:

the specific binding fragment of the IgV domain or the IgC domain has a length of at least 50, 60, 70, 80, 90, 100, 110 or more amino acids;

the specific binding fragment of the IgV domain comprises a length that is at least 80% of the length of the IgV domain set forth as amino acids 35-135 of SEQ ID NO:1; or the specific binding fragment of the IgC domain comprises a length that is at least 80% of the length of the IgC domain set forth as amino acids 145-230 of SEQ ID NO: 1.

8. The variant CD80 polypeptide of any of embodiments 1-7, wherein the variant CD80 polypeptide comprises up to 1, 2, 3, 4, 5, 6, 7, 8, 9, 10, 11, 12, 13, 14, 15, 16, 17, 18, 19 or 20 amino acid modifications, optionally amino acid substitutions.

9. The variant CD80 polypeptide of any of embodiments 1-8, wherein the variant CD80 polypeptide comprises a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 28, or a specific binding fragment thereof.

10. The variant CD80 polypeptide of any of embodiments 1-9, wherein the variant CD80 exhibits altered binding specificity to the ectodomain of CD28, PD-L1, or CTLA-4 compared to the unmodified CD80.

11. The variant CD80 polypeptide of embodiment 9, wherein the altered binding is altered binding affinity and/or altered binding selectivity.

12. The variant CD80 polypeptide of any one of embodiments 1-11, wherein the one or more amino acid substitution is V4M, K9E, E10R, V11S, A12G, A12T, A12V, T13N, L14A, S15V, S15F, C16S, C16G, C16L, G17W, H18L, H18R, H18Y, V20L, S21P, V22A, E24G, L25P, Q27R, T28A, T28S, R29C, R29D, R29H, R29V, I30V, Y31F, Y31H, Y31L, Q33H, K36E, K36G, K37E, K37Q, M38I, M38L, M38T, M38V, LAOM, T41A, T41G, T41D, T41I, M42T, M43I, M43Q, M43R, M43V, S44P, M47T, N48D, N48I, W50G, E52G, Y53C, K54M, F59L, F59S, D60V, I61N, T62S, N63S, N64S, L65H, S66H, I67F, I67T, V68A, V68M, I69T, L70Q, L70P, L70R, L72P, P74L, D76G, E77G, E77K, Y80N, E81A, E81R, E81V, V83A, V83I, L85I, L85R, K86E, Y87N, E88D, E88G, K89E, K89N, K89R, D90K, D90L, D90N, A91E, A91G, A91S, A91T, F92L, F92N, F92P, F92Y, K93I, K93E, K93Q, K93R, K93V, R94G, R94L, R94F, E95K, H96R, L97R, E99D, E99G, L102S, S103L, S103P, V104A, V104L, D107N, F108L, P109S, P109H, T110A, S114T, D115G, F116S, F116L, E117V, E117G, I118V, I118A, I118T, T120S, S121P, N122S, I126L, I126V, I127T, C128Y, C128R, S129L, S129P, T130A, G133D, P137L, S140T, L142S, E143G, N144D, N144S, L148S, N149D, N149S, N152T, T154I, T154A, E160G, E162G, Y164H, S168G, K169E, K169I, K169S, M174T, M174V, T175A, N177S, H178R, L183H, K185E, H188D, H188Q, R190S, N192D, Q193L, T199S, or a conservative amino acid substitution thereof.

13. The variant CD80 polypeptide of any one of embodiments 1-12, wherein the one or more amino acid substitution is V4M/L70Q/A91G/T120S/T130A, A12T/H18L/M43V/F59L/E77K/P109S/I118T, A12V/S15F/Y31H/T41G/

T130A/P137L/N152T, V20L/L70Q/A91S/T120S/T130A, V22A/L70Q/S121P, E24G/L25P/L70Q/T120S, T28S/L70Q/A91G/E95K/T120S/T130A, E24G/R29D/Y31L/Q33H/K36G/M38I/T41A/M43R/M47T/F59L/E81V/L85R/K89N/A91T/F92P/K93V/R94L/H96R, R29D/Y31L/Q33H/K36G/M38I/T41A/M42T/M43R/M47T/E81V/L85R/K89N/A91T/F92P/K93V/R94L/L148S/N149S, R29D/Y31L/Q33H/K36G/M38I/T41A/M43R/M47T/E81V/L85R/K89N/A91T/F92P/K93V/R94L/N149S, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144S/N149S, R29H/Y31H/T41G/Y87N/E88G/K89E/D90N/A91G/P109S, R29H/E52G/L70R/E88G/A91G/T130A, R29H/E52G/T120S/T130A, R29V/Y31F/K36G/M38L/M43Q/E81R/V83I/L85I/K89R/D90L/A91E/F92N/K93Q/R94G, R29V/M43Q/E81R/L85I/K89R/D90L/A91E/F92N/K93Q/R94G, Y31H/T41G/L70Q/A91G/T120S/T130A, K36G, K36G/K37Q/M38I/L40M, K36G/K37Q/M38I/F59L/E81V/L85R/K89N/A91T/F92P/K93V/R94L/E99G/T130A/N149S, K36E/I67T/L70Q/A91G/T120S/T130A/N152T, K37E/F59S/L70Q/A91G/T120S/T130A, M38T/L70Q/E77G/A91G/T120S/T130A/N152T, M38V/T41D/M43I/W50G/D76G/V83A/K89E/T120S/T130A, T41I/A91G, S44P/L70Q/A91G/T130A, E52G/L70Q/A91G/T120S/T130A, K54M/A91G/T120S, D60V/A91G/T120S/T130A, N63S/L70Q/A91G/T120S/T130A, S66H/D90G/T110A/F116L, I67F/L70R/E88G/A91G/T120S/T130A, I67T/L70Q/A91G/T120S, V68A/T110A, V68M/L70P/L72P/K86E, L70Q/A91G/T110A/T120S/T130A, L70Q/E81A/A91G/T120S/I127T/T130A, L70Q/Y87N/A91G/T130A, L70Q/A91G, L70Q/A91G/E117G/T120S/T130A, L70Q/A91G/T120S/T130A, L70Q/A91G/T130A, L70Q/A91G/I118A/T20S/T130A, L70R/A91G/T120S/T130A, E88D/K89R/D90K/A91G/F92Y/K93R, K89E/T130A, K89R/D90K/A91G/F92Y/K93R, K89R/D90K/A91G/F92Y/K93R/N122S/N177S, E88D/K89R/D90K/A91G/F92Y/K93R/N122S/N177S A91G, A91G/F92L/F108L/T120S, A91G/L102S, A91G/S103P, A91G/T120S/T130A, R29D/Y31L/Q33H/K36G/M38I/T41A/M43R/M47T/E81V/L85R/K89N/A91T/F92P/K93V/R94L/T120S/I127T/T130A/K169E, R29D/Y31L/Q33H/K36G/M38I/T41A/M43R/M47T/L70Q/E81V/L85R/K89N/A91T/F92P/K93V/R94L/T120S/I127T/T130A, H18L/R29D/Y31L/Q33H/K36G/M38I/T41A/M43R/M47T/E81V/L85R/K89N/A91T/F92P/K93V/R94L/T120S/I127T/T130A/K169E, R29D/Y31L/Q33H/K36G/M38I/T41A/M43R/M47T/E81V/L85R/K89N/A91T/F92P/K93V/R94L/T120S/T130A/M174T, R29D/Y31L/Q33H/K36G/M38I/T41A/M43R/M47T/F59L/E81V/L85R/K89N/A91T/F92P/K93V/R94L/T120S/I127T/T130A/H188D, H18R/R29D/Y31L/Q33H/K36G/K37E/M38I/T41A/M43R/M47T/L70Q/E81V/L85R/K89N/A91T/F92P/K93V/R94L/T120S/T130A/K169E/H188D, R29D/Y31L/Q33H/K36G/M38I/T41A/M43R/M47T/L70Q/E81V/L85R/K89N/A91T/F92P/K93V/R94L/T120S/I127T/T130A/E143G/K169E/M174V/H188D, R29D/Y31L/Q33H/K36G/M38I/T41A/M43R/M47T/L70Q/E81V/L85R/K89N/A91T/F92P/K93V/R94L/T120S/I127T/T130A, R29D/Y31L/Q33H/K36G/M38I/T41A/M43R/M47T/E81V/L85R/K89N/A91T/F92P/K93V/R94L/T120S/I127T/T130A/H188D, R29D/Y31L/Q33H/K36G/M38I/T41A/M43R/M47T/L70Q/E81V/L85R/K89N/A91T/F92P/K93V/R94L/T120S/I127T/T130A/K169E, R29D/Y31L/Q33H/K36G/M38I/T41A/M43R/M47T/L70Q/E81V/L85R/K89N/A91T/F92P/K93V/R94L/T120S/I127T/T130A, R29D/Y31L/Q33H/K36G/M38I/T41A/M43R/M47T/L85R/K89N/A91T/F92P/K93V/R94L/T120S/I127T/T130A/K169E/H188D, R29D/Y31L/Q33H/K36G/M38I/T41A/M43R/M47T/E81V/L85R/K89N/A91T/F92P/K93V/R94L/F108L/T120S/T130A/K169E/H188D, R29D/Y31L/Q33H/K36G/M38I/T41A/M43R/M47T/L70Q/E81V/L85R/K89N/A91T/F92P/K93V/R94L/T130A/H188D, R29D/Y31L/Q33H/K36G/M38I/T41A/M43R/M47T/L70Q/E81V/L85R/K89N/A91T/F92P/K93V/R94L/T120S/I127T/T130A/K169E, H18L/R29D/Y31L/Q33H/K36G/M38I/T41A/M43R/M47T/L70Q/E81V/L85R/K89N/A91T/F92P/K93V/R94L/T120S/T130A/K169E/H188D, R29D/Y31L/Q33H/K36G/M38I/T41A/M43R/M47T/E81V/L85R/K89N/A91T/F92P/K93V/R94L/T120S/I127T/C128Y/T130A/H188D, R29D/Y31L/Q33H/K36G/M38I/T41A/M43R/M47T/E81V/L85R/K89N/A91T/F92P/K93V/R94F/T130A/K169E, H18L/R29D/Y31L/Q33H/K36G/M38I/T41A/M43R/M47T/E81V/L85R/K89N/A91T/F92P/K93V/R94L/T130A, H18L/R29D/Y31L/Q33H/K36G/M38I/T41A/M43R/M47T/L70Q/E81V/L85R/K89N/A91T/F92P/K93V/R94L/T120S/T130A/K169E, R29D/Y31L/Q33H/K36G/M38I/T41A/M43R/M47T/L70Q/E81V/L85R/K89N/A91T/F92P/K93I/R94L/L97R/T130A, R29D/Y31L/Q33H/K36G/M38I/T41A/M43R/M47T/L70Q/E81V/L85R/K89N/A91T/F92P/K93I/R94L/L97R/T130A/L148S, H18L/R29D/Y31L/Q33H/K36G/M38I/T41A/M43R/M47T/E81V/L85R/K89N/A91T/F92P/K93V/R94L/I118V/T120S/I127T/T130A/K169E, R29D/Y31L/Q33H/K36G/M38I/T41A/M43R/M47T/I61N/E81V/L85R/K89N/A91T/F92P/K93V/R94F/V104A/T120S/T130A, R29D/Y31L/Q33H/K36G/M38I/T41A/M43R/M47T/E81V/L85R/K89N/F92P/K93V/R94F/I118V/T130A, R29D/Y31L/Q33H/K36G/M38I/T41A/M43R/M47T/T62S/E81V/L85R/K89N/A91T/F92P/K93V/R94L/I118V/T120S/T130A/K169E/T175A, H18L/R29D/Y31L/Q33H/K36G/M38I/T41A/M43R/M47T/E81V/L85R/K89N/A91T/F92P/K93V/R94L/F116S/T130A/H188D, H18L/R29D/Y31L/Q33H/K36G/M38I/T41A/M43R/M47T/E81V/L85R/K89N/A91T/F92P/K93V/R94L/T120S/I127T/T130A/L142S/H188D, C16S/H18L/R29D/Y31L/Q33H/K36G/M38I/T41A/M43R/M47T/E81V/L85R/K89N/A91T/F92P/K93V/R94L/T110A/H188D, R29D/Y31L/Q33H/K36G/M38I/T41A/M43R/M47T/A91G/T120S/I127T/T130A/H188D, R29D/Y31L/Q33H/K36G/M38I/T41A/M43R/M47T/L70Q/D76G/A91G/S103L/T120S/I127T/T 130A, Q33del/Y53C/L85R/K89N/A91T/F92P/K93V/R94L/T120S/I127T/T130A/K169E, T62S/E81V/L85R/K89N/A91T/F92P/K93V/R94L/T120S/T130A/K169E, R29D/Y31L/Q33H/K36G/M38I/T41A/M43R/M47T/E81V/L85R/K89N/A91T/F92P/K93V/R94L/S129L/H188D, K9E/E10R/V11S/A12G/T13N/K14A/S15V/C16L/G17W/H18Y/Y53C/L70Q/D90G/T130A/N149D/N152T/H188D, H18L/R29D/Y31L/Q33H/K36G/T41A/M43R/M47T/E81V/L85R/K89N/A91T/F92P/K93V/R94L/I118V/T120S/I127T/T130A/H188D, K89E/K93E/T130A, S21P/R29D/Y31L/Q33H/K36G/M38I/T41A/M43R/M47T/N48I/V68A/E81V/L85R/K89N/A91T/F92P/K93V/R94L/P109H/I126L/K169I, H18L/R29D/Y31L/Q33H/K36G/M38I/T41A/M43R/M47T/P74L/Y80N/E81V/L85R/K89N/A91T/F92P/K93V/R94L/L97R, S21P/R29D/Y31L/Q33H/K36G/M38I/T41A/M43R/M47T/P74L/Y80N/E81V/L85R/K89N/D90N/A91T/F92P/K93V/R94L/T130A/N149S/E162G, H18L/R29D/Y31L/Q33H/K36G/M38I/T41A/M43R/M47T/V68M/E81V/L85R/K89N/A91T/F92P/K93V/R94L/T130A, R29D/Y31L/Q33H/K36G/M38I/T41A/M43R/M47T/V68M/E81V/L85R/K89N/A91T/F92P/K93V/R94L/T130A/N149S/R190S, H18L/R29D/Y31L/Q33H/K36G/M38I/T41A/M43R/M47T/P74L/Y80N/E81V/L85R/K89N/A91T/F92P/K93V/R94L/T130A/R190S, C16G/V22A/

R29D/Y31L/Q33H/K36G/M38I/T41A/M43R/M47T/V68M/D76G/E81V/L85R/K89N/A91T/F92P/K93V/R94L/I118T/T130A/S140T/N149S/K169I/H178R/N192D, R29D/Y31L/Q33H/K36G/M38I/T41A/M43R/M47T/E81V/L85R/K89N/A91T/F92P/K93V/R94F/E117V/I118T/N149S/S168G/H188Q, V22A/R29D/Y31L/Q33H/K36G/M38I/T41A/M43R/M47T/V68M/E81V/L85R/K89N/A91T/F92P/K93V/R94L/T130A, R29D/Y31L/Q33H/K36G/M38I/T41A/M43R/M47T/N64S/E81V/L85R/K89N/A91T/F92P/K93V/R94F/I118T/T130A/N149S/K169I, V22A/R29D/Y31L/Q33H/K36G/M38I/T41A/M43R/M47T/V68M/E81V/L85R/K89N/A91T/F92P/K93V/R94L/D115G/I118T/T130A/G133D/N149S, S129P, A91G/S129P, I69T/L70Q/A91G/T120S, Y31H/S129P, T28A/R29D/Y31L/Q33H/K36G/M38I/T41A/M43R/M47T/E81V/L85R/K89N/A91T/F92P/K93V/R94L/V104L/T130A/N149S, H18L/R29D/Y31L/Q33H/K36G/M38I/T41A/M43R/M47T/E81V/L85R/K89N/A91T/F92P/K93V/R94L/L97R/N149S/H188Q, H18L/R29D/Y31L/Q33H/K36G/M38I/T41A/M43R/M47T/E81V/L85R/K89N/A91T/F92P/K93V/R94L/L97R/N149S, H18L/R29D/Y31L/Q33H/K36G/M38I/T41A/M43R/M47T/V68A/E81V/L85R/K89N/A91T/F92P/K93V/R94L/T130A/N149S/T154I, A12G/R29D/Y31L/Q33H/K36G/M38I/T41A/M43R/M47T/V68A/E81V/L85R/K89N/A91T/F92P/K93V/R94L/L97R/T130A/L183H, R29D/Y31L/Q33H/K36G/M38I/T41A/M43R/M47T/E81V/L85R/K89N/A91T/F92P/K93V/R94L/I118T/T130A/S140T/N149S/K169S, R29D/Y31L/Q33H/K36G/M38I/T41A/M43R/M47T/E81V/L85R/K89N/A91T/F92P/K93V/R94L/I118T/T130A/N149S/K169I/Q193L, V22A/R29D/Y31L/Q33H/K36G/M38I/T41A/M43R/M47T/E81V/L85R/K89N/A91T/F92P/K93V/R94L/I118T/T130A/N149S, R29D/Y31L/Q33H/K36G/M38I/T41A/M43R/M47T/E81V/L85R/K89N/A91T/F92P/K93V/R94L/I118T/T130A/N149S, R29D/Y31L/Q33H/K36G/M38I/T41A/M43R/M47T/E81V/L85R/K89N/A91T/F92P/K93V/R94L/I118T/T130A/N149S/K169I, R29D/Y31L/Q33H/K36G/M38I/T41A/M43R/M47T/E81V/L85R/K89N/A91T/F92P/K93V/R94F/T130A/N149S/K169I, I118T/C128R, Q27R/R29C/M42T/S129P/E160G, S129P/T154A, S21P/L70Q/D90G/T120S/T130A, L70Q/A91G/N144D, L70Q/A91G/I118A/T120S/T130A/K169E, V4M/L70Q/A91G/I118V/T120S/T130A/K169E, L70Q/A91G/I118V/T120S/T130A/K169E, L70Q/A91G/I118V/T120S/T130A, V20L/L70Q/A91S/I118V/T120S/T130A, L70Q/A91G/E117G/I118V/T120S/T130A, A91G/I118V/T120S/T130A, L70R/A91G/I118V/T120S/T130A/T199S, L70Q/E81A/A91G/I118V/T120S/I127T/T130A, T28S/L70Q/A91G/E95K/I118V/T120S/I126V/T130A/K169E, N63S/L70Q/A91G/S114T/I118V/T120S/T130A, K36E/I67T/L70Q/A91G/I118V/T120S/T130A/N152T, E52G/L70Q/A91G/D107N/I118V/T120S/T130A/K169E, K37E/F59S/L70Q/A91G/I118V/T120S/T130A/K185E, D60V/A91G/I118V/T120S/T130AK169E, K54M/L70Q/A91G/Y164H, M38T/L70Q/E77G/A91G/I118V/T120S/T130A/N152T, Y31H/T41G/M43L/L70Q/A91G/I118V/T120S/I126V/T130A, Y31H/T41G/M43L/L70Q/A91G/I118V/T120S/I126V/T130A, L65H/D90G/T110A/F116L, R29H/E52G/D90N/I118V/T120S/T130A, I67T/L70Q/A91G/I118V/T120S, L70Q/A91G/T110A/I118V/T120S/T130A, M38V/T41D/M43I/W50G/D76G/V83A/K89E/I118V/T120S/I126V/T130A, A12V/S15F/Y31H/M38L/T41 G/M43L/D90N/T130A/P137L/N149D/N152T, I67F/L70R/E88G/A91G/I118V/T120S/T130A, E24G/L25P/L70Q/A91G/I118V/T120S/N152T, E24G/L25P/L70Q/A91G/I118V/T120S/N152T, A91G/F92L/F108L/I118V/T120S, E88D/K89R/D90K/A91G/F92Y/K93R/N122S/N177S, K36G/K37Q/M38I/L40M/F59L/E81V/L85R/K89N/A91T/F92P/K93V/R94L/E99G/T130A/N149S, K36G/L40M, R29D/Y31L/Q33H/K36G/M38I/T41A/M43R/M47T/E81V/L85R/K89N/A91T/F92P/K93V/R94L/I118V/T120S/I127T/T130A/K169E, R29D/Y31L/Q33H/K36G/M38I/T41A/M43R/M47T/L70Q/E81V/L85R/K89N/A91T/F92P/K93V/R94L/I118V/T120S/I127T/T130A, H18L/R29D/Y31L/Q33H/K36G/M38I/T41A/M43R/M47T/E81V/L85R/K89N/A91T/F92P/K93V/R94L/I118V/T120S/I127T/T130A/K169E, R29D/Y31L/Q33H/K36G/M38I/T41A/M43R/M47T/E81V/L85R/K89N/A91T/F92P/K93V/R94L/I118V/T120S/T130A/K169E/M174T, R29D/Y31L/Q33H/K36G/M38I/T41A/M43R/M47T/N48D/F59L/E81V/L85R/K89N/A91T/F92P/K93V/R94L/I118V/T120S/I127T/T130A/H188D, H18R/R29D/Y31L/Q33H/K36G/K37E/M38I/T41A/M43R/M47T/L70Q/E81V/L85R/K89N/A91T/F92P/K93V/R94L/I118V/T120S/T130A/K169E/H188D, R29D/Y31L/Q33H/K36G/M38I/T41A/M43R/M47T/L70Q/E81V/L85R/K89N/A91T/F92P/K93V/R94L/I118V/T120S/I127T/T130A/E143G/K169E/M174V/H188D, R29D/I30V/Y31L/Q33H/K36G/M38I/T41A/M43R/M47T/E81V/L85R/K89N/A91T/F92P/K93V/R94L/I118V/T120S/I127T/T130A/H188D, R29D/Y31L/Q33H/K36G/M38I/T41A/M43R/M47T/E81V/L85R/K89N/A91T/F92P/K93V/R94L/I118V/T120S/I127T/T130A/H188D, R29D/Y31L/Q33H/K36G/M38I/T41A/M43R/M47T/L70Q/E81V/L85R/K89N/A91T/F92P/K93V/R94L/I118V/T120S/I127T/T130A/K169E, R29D/Y31L/Q33H/K36G/M38I/T41A/M43R/M47T/L70Q/E81V/K89N/A91T/F92P/K93V/R94L/I118V/T120S/I127T/T130A, R29D/Y31L/Q33H/K36G/M38I/T41A/M43R/M47T/L70Q/E81V/K89N/A91T/F92P/K93V/R94L/I118V/T120S/I127T/T130A, R29D/Y31L/Q33H/K36G/M38I/T41A/M43R/M47T/L85R/K89N/A91T/F92P/K93V/R94L/I118V/T120S/I127T/T130A/K169E/H188D, R29D/Y31L/Q33H/K36G/M38I/T41A/M43R/M47T/E81V/L85R/K89N/A91T/F92P/K93V/R94L/F108L/I18V/T2S/120S/T130A/K169E/H188D, R29D/Y31L/Q33H/K36G/M38I/T41A/M43R/M47T/L70Q/E81V/L85R/K89N/A91T/F92P/K93V/R94L/I118V/T120S/T130A/N149D/K169E/H188D, H18L/R29D/Y31L/Q33H/K36G/M38I/T41A/M43R/M47T/L70Q/E81V/L85R/K89N/A91T/F92P/K93V/R94L/I118V/T120S/T130A/K169E/H188D, R29D/Y31L/Q33H/K36G/M38I/T41A/M43R/M47T/E81V/L85R/K89N/A91T/F92P/K93V/R94L/I118V/T120S/I127T/C128Y/T130A/H188D, H18L/R29D/Y31L/Q33H/K36G/M38I/T41A/M43R/M47T/E81V/L85R/K89N/A91T/F92P/K93V/R94L/E99D/T130A, H18L/R29D/Y31L/Q33H/K36G/M38I/T41A/M43R/M47T/L70Q/E81V/L85R/K89N/A91T/F92P/K93V/R94L/I118V/T120S/T130A/K169E, R29D/Y31L/Q33H/K36G/M38I/T41A/M43R/M47T/I61N/E81V/L85R/K89N/A91T/F92P/K93V/R94F/V104A/I118V/T120S/I126V/T130A, R29D/Y31L/Q33H/K36G/M38I/T41A/M43R/M47T/E81V/L85R/K89N/A91T/F92P/K93V/R94F/I118V/T120S/T130A, R29D/Y31L/Q33H/K36G/M38I/T41A/M43R/M47T/E81V/L85R/K89N/A91T/F92P/K93V/R94F/I118V/T120S/T130A R29D/Y31L/Q33H/K36G/M38I/T41A/M43R/M47T/T62S/E81V/L85R/K89N/A91T/F92P/K93V/R94L/I118V/T120S/T130A/K169E/T175A, H18L/R29D/Y31L/Q33H/K36G/M38I/T41A/M43R/M47T/E81V/L85R/K89N/A91T/F92P/K93V/R94L/I118V/T120S/I127T/T130A/L142S/H188D, C16S/H18L/R29D/Y31L/Q33H/K36G/M38I/T41A/M43R/M47T/E81V/L85R/K89N/A91T/F92P/K93V/R94L/T110A/I118V/H188D, R29D/Y31L/Q33H/K36G/M38I/T41A/M43R/M47T/A91G/I118V/T120S/I127T/T130A/H188D, R29D/Y31L/Q33H/K36G/M38I/T41A/M43R/M47T/L70Q/D76G/A91G/S103L/I118V/T120S/I127T/T130A, Y53C/L85R/

K89N/A91T/F92P/K93V/R94L/I118V/T120S/I127T/T130A/K169E, Y53C/L85R/K89N/A91T/F92P/K93V/R94L/I118V/T120S/I127T/T130A/K169E, T62S/E81V/L85R/K89N/A91T/F92P/K93V/R94L/I118V/T120S/T130A/K169E, Y53C/L70Q/D90G/T130A/N149D/N152T/H188D, Y53C/L70Q/D90G/T130A/N149D/N152T/H188D, H18L/R29D/Y31L/Q33H/K36G/M38I/T41A/M43R/M47T/E81V/L85R/K89N/A91T/F92P/K93V/R94L/I118V/T120S/I127T/T130A/H188D, or H18L/R29D/Y31L/Q33H/K36G/M38I/T41A/M43R/M47T/E81V/L85R/K89N/A91T/F92P/K93V/R94L/T130A/N149S.

14. The variant CD80 polypeptide of any of embodiments 1-13, comprising the sequence of amino acids set forth in any of SEQ ID NOS: 55-108, 280-346, 414-475 or a specific binding fragment thereof, or a sequence of amino acids that exhibits at least 95% sequence identity to any of SEQ ID NOS:55-108, 280-346, 414-475 or a specific binding fragment thereof and that contains the one or more of the amino acid substitutions.

15. The variant CD80 polypeptide of any of embodiments 1-14, wherein the variant CD80 polypeptide comprises the IgV domain or a specific binding fragment thereof.

16. The variant CD80 polypeptide of any of embodiments 1-15, wherein the IgV domain or specific fragment thereof is the only CD80 portion of the variant CD80 polypeptide.

17. The variant CD80 polypeptide of any of embodiments 1-14, wherein the IgC domain or specific fragment thereof is the only CD80 portion of the variant CD80 polypeptide.

18. The variant CD80 polypeptide of any of embodiments 1-17, comprising the sequence of amino acids set forth in any of SEQ ID NOS: 153-195, 347, 373-386, 476-477 or a specific binding fragment thereof, a sequence of amino acids that exhibits at least 95% sequence identity to any of SEQ ID NOS: 153-195, 347, 373-386, 476-477 or a specific binding fragment thereof and that contains the one or more of the amino acid substitutions.

19. The variant CD80 polypeptide of any of embodiments 1-17, wherein the variant CD80 polypeptide specifically binds to the ectodomain of CD28, PD-L1, or CTLA-4 with increased affinity compared to the unmodified CD80 polypeptide.

20. The variant CD80 polypeptide of any of embodiments 1-19, wherein the variant polypeptide specifically binds to the ectodomain of CD28, PD-L1 or CTLA-4 with increased selectivity compared to the binding of the unmodified CD80 for the ectodomain.

21. The variant CD80 polypeptide of embodiment 20, wherein the increased selectivity comprises a greater ratio for one cognate binding partner selected from among CD28, PD-L1 and CTLA-4 versus another of the cognate binding partner compared to the ratio of binding of the unmodified CD80 polypeptide for the one cognate binding partner versus the another of the cognate binding partner.

22. The variant CD80 polypeptide of embodiment 19 or embodiment 20, wherein the variant polypeptide specifically binds to the ectodomain of CD28 with increased selectivity compared to the binding of the unmodified CD80 for the ectodomain of CD28.

23. The variant CD80 polypeptide of embodiment 22, wherein the increased selectivity comprises a greater ratio for binding CD28 versus PD-L1 or CTLA-4 compared to the ratio of binding of the unmodified CD80 polypeptide for CD28 versus PD-L1 or CTLA-4.

24. The variant CD80 polypeptide of embodiment 21 or embodiment 23, wherein the ratio is greater by at least or at least about 1.5-fold, 2.0-fold, 3.0-fold, 4.0-fold. 5-fold, 10-fold, 15-fold, 20-fold, 30-fold, 40-fold, 50-fold or more.

25. The variant CD80 polypeptide of any of embodiments 1-24, wherein the variant CD80 polypeptide specifically binds to the ectodomain of CD28 with increased affinity compared to the unmodified CD80 polypeptide.

26. The variant CD80 polypeptide of embodiment 19 or embodiment 25, wherein the increased affinity to the ectodomain is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to the binding affinity of the unmodified CD80 for the ectodomain.

27. The variant CD80 polypeptide of any of embodiments 1-26, wherein the one or more amino acid substitutions corresponds to position(s) 12, 18, 20, 29, 31, 36, 40, 41, 43, 52, 59, 60, 63, 67, 70, 77, 81, 87, 88, 89, 90, 91, 92, 93, 107, 109, 114, 117, 118, 120, 122, 127, 130, 144, 169, 177 or 199 with reference to numbering of SEQ ID NO: 28.

28. The variant CD80 polypeptide of any of embodiments 1-27, wherein the one or more amino acid substitution is selected from the group consisting of A12T, H18L, V20L, R29H, Y31H, K36G, T41G, T41I, M43V, E52G, F59L, D60V, N63S, I67T, L70Q, L70R, E77K, E81A, Y87N, E88D, E88G, K89E, K89R, D90K, D90N, L40M, A91G, A91S, F92Y, K93R, D107N, P109S, S114T, E117G, I118A, I118T, I118V, T120S, I127T, T130A, N144D, K169E, N177S, and T199S and conservative amino acid substitutions thereof.

29. The variant CD80 polypeptide of any of embodiments 1-28, wherein the one or more amino acid substitution is A12T/H18L/M43V/F59L/E77K/P109S/I118T, V20L/L70Q/A91S/T120S/T130A, V20L/L70Q/A91S/I118V/T120S/T130A, R29H/Y31H/T41G/Y87N/E88G/K89E/D90N/A91G/P109S, K36G, K36G/L40M, T41 I/A91G, E52G/L70/A91G/T120S/T130A, E52G/L70Q/A91G/D107N/I118V/T120S/T130A/K169E, D60V/A91G/T120S/T130A, D60V/A91G/I118V/T120S/T130A/K169E, N63S/L70Q/A91G/T120S/T130A, N63S/L70Q/A91G/S114T/I118V/T120S/T130A, I67T/L70Q/A91G/T120S, I67T/L70Q/A91G/I118V/T120S, L70Q/E81A/A91G/T120S/I127T/T130A, L70Q/E81A/A91G/I118V/T120S/I127T/T130A, L70Q/Y87N/A91G/T130A, L70Q/A91G, L70Q/A91G/N144D, L70Q/A91G/E117G/T120S/T130A, L70Q/A91G/E117G/I118V/T120S/T130A, L70Q/A91G/I118A/T120S/T130A, L70Q/A91G/I118A/T120S/T130A/K169E, L70Q/A91G/T120S/T130A, L70R/A91G/T120S/T130A, L70R/A91G/I118V/T120S/T130A/T199S L70Q/A91G/I118V/T120S/T130A/K169E, E88D/K89R/D90K/A91G/F92Y/K93R, K89R/D90K/A91G/F92Y/K93R, E88D/K89R/D90K/A91G/F92Y/K93R/N122S/N177S, or K89R/D90K/A91G/F92Y/K93R/N122S/N177S.

30. The variant CD80 polypeptide of any of embodiments 1-29, wherein the variant CD80 polypeptide specifically binds to the ectodomain of PD-L1 with increased affinity compared to the unmodified CD80 polypeptide.

31. The variant CD80 polypeptide of embodiment 30, wherein the increased affinity to the ectodomain is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to the binding affinity of the unmodified CD80 for the ectodomain.

32. The variant CD80 polypeptide of any of embodiments 1-31, wherein the variant polypeptide specifically binds to the ectodomain of PD-L1 with increased selectivity compared to the binding of the unmodified CD80 for the ectodomain.

33. The variant CD80 polypeptide of embodiment 32, wherein the increased selectivity comprises a greater ratio for binding PD-L1 versus CD28 or CTLA-4 compared to the ratio of binding of the unmodified CD80 polypeptide for PD-L1 versus CD28 or CTLA-4.

34. The variant CD80 polypeptide of embodiment 33, wherein the ratio is greater by at least or at least about 1.5-fold, 2.0-fold, 3.0-fold, 4.0-fold. 5-fold, 10-fold, 15-fold, 20-fold, 30-fold, 40-fold, 50-fold or more.

35. The variant CD80 polypeptide of any of embodiments 1-34, wherein the one or more amino acid substitutions corresponds to position(s) 12, 18, 29, 31, 33, 36, 38, 40, 41, 42, 43, 47, 48, 59, 64, 67, 68, 70, 77, 81, 85, 87, 88, 89, 90, 91, 92, 93, 94, 97, 104, 109, 115, 117, 118, 120, 122, 126, 130, 133, 140, 144, 148, 149, 168, 178, 183, 188 or 193 with reference to numbering of SEQ ID NO: 28.

36. The variant CD80 polypeptide of any of embodiments 1-35, wherein the one or more amino acid substitution is selected from the group consisting of A12G, A12T, H18L, S21P, V22A, T28A, R29D, R29H, Y31H, Y31L, Q33H, K36G, M38I, M38L, L40M, T41A, T41G, M42T, M43R, M43V, M47T, N48I, F59L, N64S, I67T, V68A, V68M, L70Q, E77K, E81V, L85R, Y87N, E88D, E88G, K89E, K89N, K89R, D90K, D90N, A91G, A91T, F92P, F92Y, K93V, R94F, R94L, L97R, S103L, S103P, V104L, P109H, P109S, D115G, E117V, 118T, I118V, T120S, N122S, I126L, T130A, G133D, S140T, N144S, L148S, N149S, S168G, K169I, K169S, N177S, H178R, L183H, H188Q, R190S and Q193L, and conservative amino acid substitutions thereof.

37. The variant CD80 polypeptide of any of embodiments 1-36, wherein the one or more amino acid substitution is A12T/H18L/M43V/F59L/E77K/P109S/I118T, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144S/N149S, R29D/Y31L/Q33H/K36G/M38I/T41A/M42T/M43R/M47T/E81V/L85R/K89N/A91T/F92P/K93V/R94L/L148S/N149S, R29D/Y31L/Q33H/K36G/M38I/T41A/M43R/M47T/E81V/L85R/K89N/A91T/F92P/K93V/R94L/N149S, R29H/Y31H/T41G/Y87N/E88G/K89E/D90N/A91G/P109S, K36G, K36G/L40M, I67T/L70Q/A91G/T120S, I67T/L70Q/A91G/I118V/T120S, E88D/K89R/D90K/A91G/F92Y/K93R, K89R/D90K/A91G/F92Y/K93R, A91G, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94 L/N144S/N149S, R29D/Y31L/Q33H/K36G/M38I/T41A/M42T/M43R/M47T/E81V/L85R/K89N/A91T/F92P/K93V/R94L/L148S/N149S, R29D/Y31L/Q33H/K36G/M38I/T41A/M43R/M47T/E81V/L85R/K89N/A91T/F92P/K93V/R94L/N149S, R29H/Y31H/T41G/Y87N/E88G/K89E/D90N/A91G/P109S, K36G, K36G/L40M, I67T/L70Q/A91G/T120S, I67T/L70Q/A91G/I118V/T120S, E88D/K89R/D90K/A91G/F92Y/K93R, K89R/D90K/A91G/F92Y/K93R, A91G, H18L/R29D/Y31L/Q33H/K36G/M38I/T41A/M43R/M47T/E81V/L85R/K89N/A91T/F92P/K93V/R94L/I118V/T120S/I127T/T130A/H188D, R29D/Y31L/Q33H/K36G/M38I/T41A/M43R/M47T/V68M/E81V/L85R/K89N/A91T/F92P/K93V/R94L/T130A/N149S/R190S, R29D/Y31L/Q33H/K36G/M38I/T41A/M43R/M47T/E81V/L85R/K89N/A91T/F92P/K93V/R94F/E117V/I118T/N149S/S168G/H188Q, V22A/R29D/Y31L/Q33H/K36G/M38I/T41A/M43R/M47T/V68M/E81V/L85R/K89N/A91T/F92P/K93V/R94L/T130A, R29D/Y31L/Q33H/K36G/M38I/T41A/M43R/M47T/N64S/E81V/L85R/K89N/A91T/F92P/K93V/R94F/I118T/T130A/N149S/K169I, V22A/R29D/Y31L/Q33H/K36G/M38I/T41A/M43R/M47T/V68M/E81V/L85R/K89N/A91T/F92P/K93V/R94L/D115G/I118T/T130A/G133D/N149S, T28A/R29D/Y31L/Q33H/K36G/M38I/T41A/M43R/M47T/E81V/L85R/K89N/A91T/F92P/K93V/R94L/V104L/T130A/N149S, H18L/R29D/Y31L/Q33H/K36G/M38I/T41A/M43R/M47T/E81V/L85R/K89N/A91T/F92P/K93V/R94L/L97R/N149S/H188Q, K89E/T130A, K89E/K93E/T130A, S21P/R29D/Y31L/Q33H/K36G/M38I/T41A/M43R/M47T/N48I/V68A/E81V/L85R/K89N/A91T/F92P/K93V/R94L/S21P/N48I/V68A/P109H/I126L/K169I, H18L/R29D/Y31L/Q33H/K36G/M38I/T41A/M43R/M47T/V68M/E81V/L85R/K89N/A91T/F92P/K93V/R94L/T130A, H18L/R29D/Y31L/Q33H/K36G/M38I/T41A/M43R/M47T/E81V/L85R/K89N/A91T/F92P/K93V/R94L/T130A/N149S, A12G/R29D/Y31L/Q33H/K36G/M38I/T41A/M43R/M47T/V68A/E81V/L85R/K89N/A91T/F92P/K93V/R94L/L97R/T130A/L183H, R29D/Y31L/Q33H/K36G/M38I/T41A/M43R/M47T/E81V/L85R/K89N/A91T/F92P/K93V/R94 L/I118T/T130A/S140T/N149S/K169S, R29D/Y31L/Q33H/K36G/M38I/T41A/M43R/M47T/E81V/L85R/K89N/A91T/F92P/K93V/R94L/I118T/T130A/N149S/K169I/Q193L, V22A/R29D/Y31L/Q33H/K36G/M38I/T41A/M43R/M47T/E81V/L85R/K89N/A91T/F92P/K93V/R94L/I118T/T130A/N149S, R29D/Y31L/Q33H/K36G/M38I/T41A/M43R/M47T/E81V/L85R/K89N/A91T/F92P/K93V/R94L/I118T/T130A/N149S, R29D/Y31L/Q33H/K36G/M38I/T41A/M43R/M47T/E81V/L85R/K89N/A91T/F92P/K93V/R94L/I118T/T130A/N149S/K169I, or R29D/Y31L/Q33H/K36G/M38I/T41A/M43R/M47T/E81V/L85R/K89N/A91T/F92P/K93V/R94F/T130A/N149S/K169I.

38. The variant CD80 polypeptide of any of embodiments 1-37, wherein the variant CD80 polypeptide specifically binds to the ectodomain of CD28 and the ectodomain of PD-L1 with increased affinity compared to the unmodified CD80 polypeptide.

39. The variant CD80 polypeptide of any of embodiments 1-38, wherein the one or more amino acid substitutions corresponds to position(s) 12, 18, 36, 40, 43, 59, 77, 88, 89, 90, 91, 92, 93, 94, 109, 118, 122, or 177 with reference to numbering of SEQ ID NO: 28.

40. The variant CD80 polypeptide of any of embodiments 1-39, wherein the one or more amino acid substitution is selected from the group consisting of A12T, H18L, K36G, L40M, M43V, F59L, E77K, E88D, K89R, D90K, A91G, F92Y, K93R, P109S, I118T, N112S, N177S, and conservative amino acid substitutions thereof.

41. The variant CD80 polypeptide of any of embodiments 1-40, wherein the one or more amino acid substitution is A12T/H18L/M43V/F59L/E77K/P109S/I118T, K36G, K36G/L40M, E88D/K89R/D90K/A91G/F92Y/K93R, K89R/D90K/A91G/F92Y/K93R, E88D/K89R/D90K/A91G/F92Y/K93R/N122S/N177S, or K89R/D90K/A91G/F92Y/K93R/N122S/N177S.

42. The variant CD80 polypeptide of any of embodiments 1-41, wherein the variant CD80 polypeptide specifically binds to the ectodomain of CTLA-4 with increased affinity compared to the unmodified CD80 polypeptide.

43. The variant CD80 polypeptide of embodiment 42, wherein the increased affinity to the ectodomain is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to the binding affinity of the unmodified CD80 for the ectodomain.

44. The variant CD80 polypeptide of any of embodiments 1-43, wherein the variant polypeptide specifically binds to the ectodomain of CTLA-4 with increased selectivity compared to the binding of the unmodified CD80 for the ectodomain.

45. The variant CD80 polypeptide of embodiment 44, wherein the increased selectivity comprises a greater ratio for binding CTLA-4 versus CD28 or PD-L1 compared to the ratio of binding of the unmodified CD80 polypeptide for CTLA-4 versus CD28 or PD-L1.

46. The variant CD80 polypeptide of embodiment 45, wherein the ratio is greater by at least or at least about 1.5-fold, 2.0-fold, 3.0-fold, 4.0-fold. 5-fold, 10-fold, 15-fold, 20-fold, 30-fold, 40-fold, 50-fold or more.

47. The variant CD80 polypeptide of any of embodiments 1-46, wherein the one or more amino acid substitutions corresponds to position(s) 4, 29, 31, 36, 40, 41, 52, 67, 68, 70, 87, 88, 89, 90, 91, 92, 93, 107, 109, 110, 118, 120, 130, 144, or 169 with reference to numbering of SEQ ID NO: 28.

48. The variant CD80 polypeptide of any of embodiments 1-47, wherein the one or more amino acid substitution is selected from the group consisting of V4M, R29H, Y31H, K36G, L40M T41G, E52G, I67T, V68A, L70Q, Y87N, E88D, E88G, K89E, K89R, D90K, D90N, A91G, F92Y, K93R, D107N, P109S, T110A, I118V, T120S, T130A, N144D, and K169E and conservative amino acid substitutions thereof.

49. The variant CD80 polypeptide of any of embodiments 1-48, wherein the one or more amino acid substitution is V4M/L70Q/A91G/T120S/T130A, V4M/L70Q/A91G/I118V/T120S/T130A/K169E, R29H/Y31H/T41G/Y87N/E88G/K89E/D90N/A91G/P109S, K36G, K36G/L40M, E52G/L70Q/A91G/T120S/T130A, E52G/L70Q/A91G/D107N/I118V/T120S/T130A/K169E, I67T/L70Q/A91G/T120S, I67T/L70Q/A91G/I118V/T120S, V68A/T110A, L70Q/A91G, L70Q/A91G/N144D, L70Q/A91G/T120S/T130A, L70Q/A91G/I118V/T120S/T130A/K169E, L70Q/A91G/T130A, K89R/D90K/A91G/F92Y/K93R, E88D/K89R/D90K/A91G/F92Y/K93R, A91G/I118V/T120S/T130A, or A91G/T120S/T130A.

50. The variant CD80 polypeptide of any of embodiments 1-49, wherein the variant CD80 polypeptide specifically binds to the ectodomain of CD28 and the ectodomain of CTLA-4 with increased affinity compared to the unmodified CD80 polypeptide.

51. The variant CD80 polypeptide of any of embodiments 1-50, wherein the one or more amino acid substitutions corresponds to position(s) 36, 40, 52, 70, 88, 89, 90, 91, 92, 93, 107, 118, 120, 130, 144, or 169 of SEQ ID NO: 28.

52. The variant CD80 polypeptide of any of embodiments 1-51, wherein the one or more amino acid substitution is selected from the group consisting of K36G, L40M, E52G, L70Q, E88D, K89R, D90K, A91G, F92Y, K93R, D107N, I118V, T120S, T130A, N144D, and K169E, and conservative amino acid substitutions thereof.

53. The variant CD80 polypeptide of any of embodiments 1-52, wherein the one or more amino acid substitution is K36G, K36G/L40M, K36G/L40M, K36G/L40M, E52G/L70Q/A91G/T120S/T130A, E52G/L70Q/A91G/D107N/I118V/T120S/T130A/K169E, L70Q/A91G, L70Q/A91G/N144D, L70Q/A91G/T120S/T130A, L70Q/A91G/I118V/T120S/T130A/K169E, E88D/K89R/D90K/A91G/F92Y/K93R, or K89R/D90K/A91G/F92Y/K93R.

54. The variant CD80 polypeptide of any of embodiments 1-53, wherein the variant CD80 polypeptide specifically binds to the ectodomain of PD-L1 and the ectodomain of CTLA-4 with increased affinity compared to the unmodified CD80 polypeptide.

55. The variant CD80 polypeptide of any of embodiments 1-54, wherein the one or more amino acid substitutions corresponds to position(s) 29, 31, 36, 40, 41, 67, 70, 87, 88, 89, 90, 91, 92, 93, 109, 118, 120, 122, 130, or 178 of SEQ ID NO: 28.

56. The variant CD80 polypeptide of any of embodiments 1-55, wherein the one or more amino acid substitution is selected from the group consisting of R29H, Y31H, K36G, L40M, T41G, I67T, L70Q, Y87N, E88D, E88G, K89E, K89R, D90N, D90K, A91G, F92Y, K93R, P109S, I118V, T120S, and conservative amino acid substitutions thereof.

57. The variant CD80 polypeptide of any of embodiments 1-56, wherein the one or more amino acid substitution is R29H/Y31H/T41G/Y87N/E88G/K89E/D90N/A91G/P109S, K36G, K36G/L40M, I67T/L70Q/A91G/T120S, I67T/L70Q/A91G/I118V/T120S, E88D/K89R/D90K/A91G/F92Y/K93R, or K89R/D90K/A91G/F92Y/K93R.

58. The variant CD80 polypeptide of any of embodiments 1-57, wherein the variant CD80 polypeptide specifically binds to the ectodomain of CD28, the ectodomain of PD-L1, and the ectodomain of CTLA-4 with increased affinity compared to the unmodified CD80 polypeptide.

59. The variant CD80 polypeptide of any of embodiments 1-58, wherein the one or more amino acid substitutions corresponds to position(s) 36, 40, 88, 89, 90, 91, 92, or 93 of SEQ ID NO: 28.

60. The variant CD80 polypeptide of any of embodiments 1-59, wherein the one or more amino acid substitution is selected from the group consisting of K36G, L40M, E88D, K89R, D90K, A91G, F92Y, K93R, and conservative amino acid substitutions thereof.

61. The variant CD80 polypeptide of any of embodiments 1-60, wherein the one or more amino acid substitution is K36G, K36G/L40M E88D/K89R/D90K/A91G/F92Y/K93R, or K89R/D90K/A91G/F92Y/K93R.

62. The variant CD80 polypeptide of any of embodiments 1-41, wherein:

the variant CD80 polypeptide specifically binds to the ectodomain of CD28 or the ectodomain of PD-L1 with increased affinity compared to the unmodified CD80 polypeptide, and the variant CD80 polypeptide specifically binds to the ectodomain of CTLA-4 with decreased affinity compared to the unmodified CD80 polypeptide.

63. The variant CD80 polypeptide of any of embodiments 1-41 and 62, wherein the one or more amino acid substitutions corresponds to position(s) 29, 31, 33, 36, 38, 41, 42, 43, 47, 63, 67, 70, 81, 85, 87, 88, 89, 90, 91, 92, 93, 94, 109, 114, 118, 120, 127, 130, 144, 148, or 149 with reference to numbering of SEQ ID NO: 28.

64. The variant CD80 polypeptide of any of embodiments 1-41, 62, and 63, wherein the one or more amino acid substitution is selected from the group consisting of R29D, R29H, Y31H, Y31L, Q33H, K36G, M38I, T41A, T41G, M42T, M43R, M47T, N63S, I67T, L70Q, E81A, E81V, L85R, Y87N, E88G, K89E, K89N, D90N, A91G, A91T, F92P, K93V, R94L, P109S, S114T, I118T, I118V, T120S, I127T, T130A, N144S, L148S, and N149S, and conservative amino acid substitutions thereof.

65. The variant CD80 polypeptide of any of embodiments 1-41 and 62-64, wherein the one or more amino acid substitution is N63S/L70Q/A91G/T120S/T130A, N63S/L70Q/A91G/S114T/I118V/T120S/T130A or L70Q/Y87N/A91G/T120S/I127T/T130A.

66. The variant CD80 polypeptide of any of embodiments 1-41 and 62-65, wherein: the variant CD80 polypeptide specifically binds to the ectodomain of CD28 with increased affinity compared to the unmodified CD80 polypeptide, and the variant CD80 polypeptide specifically binds to the ectodomain of CTLA-4 with decreased affinity compared to the unmodified CD80 polypeptide.

67. The variant CD80 polypeptide of any of embodiments 1-41 and 62-66, wherein the one or more amino acid substitutions corresponds to position(s) 63, 70, 81, 87, 91, 114, 118, 120, 127, or 130 of SEQ ID NO: 28.

68. The variant CD80 polypeptide of any of embodiments 1-41, and 62-67, wherein the one or more amino acid substitution is selected from the group consisting of N63S, L70Q, E81A, Y87N, A91G, S114T, I118V, T120S, I127T, and T130A, and conservative amino acid substitutions thereof.

69. The variant CD80 polypeptide of any of embodiments 1-41, and 62-67, wherein the one or more amino acid substitution is R29D/Y31L/Q33H/K36G/M38I/T41A/M42T/M43R/M47T/E81V/L85R/K89N/A91T/F92P/K93V/R94L/L148S/N149S, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144S/N149S, R29D/Y31L/Q33H/K36G/M38I/T41A/M43R/M47T/E81V/L85R/K89N/A91T/F92P/K93V/R94L/N149S, R29H/Y31H/T41G/Y87N/E88G/K89E/D90N/A91G/P109S, N63S/L70Q/A91G/T120S/T130A, N63S/L70Q/A91G/S114T/I118V/T120S/T130A, I67T/L70Q/A91G/T120S, I67T/L70Q/A91G/I118V/T120S, or L70Q/Y87N/A91G/T120S/I127T/T130A.

70. The variant CD80 polypeptide of any of embodiments 1-41 and 62-69, wherein: the variant CD80 polypeptide specifically binds to the ectodomain of PD-L1 with increased affinity compared to the unmodified CD80 polypeptide, and the variant CD80 polypeptide specifically binds to the ectodomain of CTLA-4 with decreased affinity compared to the unmodified CD80 polypeptide.

71. The variant CD80 polypeptide of any of embodiments 1-41 and 62-70, wherein the one or more amino acid substitutions corresponds to position(s) 29, 31, 33, 36, 38, 41, 42, 43, 47, 67, 70, 81, 85, 87, 88, 89, 90, 91, 92, 93, 94, 109, 118, 120, 144, 148, or 149 of SEQ ID NO: 28.

72. The variant CD80 polypeptide of any of embodiments 1-41, and 62-71, wherein the one or more amino acid substitution is selected from the group consisting of R29D, R29H, Y31H, Y31L, Q33H, K36G, M38I, T41A, T41G, M42T, M43R, M47T, I67T, L70Q, E81V, L85R, Y87N, E88G, K89E, K89N, D90N, A91G, A91T, F92P, K93V, R94L, P109S, I118T, I118V, T120S, N144S, L148S, and N149S, and conservative amino acid substitutions thereof.

73. The variant CD80 polypeptide of any of embodiments 1-41, and 62-72, wherein the one or more amino acid substitution is R29D/Y31L/Q33H/K36G/M38I/T41A/M42T/M43R/M47T/E81V/L85R/K89N/A91T/F92P/K93V/R94L/L148S/N149S, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144S/N149S, R29D/Y31L/Q33H/K36G/M38I/T41A/M43R/M47T/E81V/L85R/K89N/A91T/F92P/K93V/R94L/N149S, R29H/Y31H/T41G/Y87N/E88G/K89E/D90N/A91G/P109S, I67T/L70Q/A91G/I118V/T120S or I67T/L70Q/A91G/T120S.

74. The variant CD80 polypeptide of any of embodiments 1-41 and 62-73, wherein: the variant CD80 polypeptide specifically binds to the ectodomain of CD28 and the ectodomain of PD-L1 with increased affinity compared to the unmodified CD80 polypeptide, and the variant CD80 polypeptide specifically binds to the ectodomain of CTLA-4 with decreased affinity compared to the unmodified CD80 polypeptide.

75. The variant CD80 polypeptide of any of embodiments 1-41 and 62-74, wherein the one or more amino acid substitutions corresponds to position(s) of 70, 81, 87, 91, or 120 of SEQ ID NO: 28.

76. The variant CD80 polypeptide of any of embodiments 1-41, and 62-75, wherein the one or more amino acid substitution is selected from the group consisting of L70Q, Y87N, A91G, and T120S, and conservative amino acid substitutions thereof.

77. The variant CD80 polypeptide of any of embodiments 10-76, wherein the CD28 is a human CD28.

78. The variant CD80 polypeptide of any of embodiments 10-77, wherein the PD-L1 is a human PD-L1.

79. The variant CD80 polypeptide of any of embodiments 10-78, wherein the CTLA-4 is a human CTLA-4.

80. The variant CD80 polypeptide of any of embodiments 1-79, wherein the binding activity is altered (increased or decreased) more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold compared to the unmodified CD80 polypeptide.

81. The variant CD80 polypeptide of any of embodiments 1-80 that is a soluble protein.

82. The variant CD80 polypeptide of any of embodiments 1-81 that is linked to a multimerization domain.

83. The variant CD80 polypeptide of any of embodiments 1-81, wherein the variant CD80 polypeptide is a multimeric polypeptide, optionally a dimeric polypeptide, comprising a first variant CD80 polypeptide linked to a multimerization domain and a second variant CD80 polypeptide linked to a multimerization domain.

84. The variant CD80 polypeptide of embodiment 83, wherein the first variant CD80 polypeptide and the second variant CD80 polypeptide are the same or different.

85. The variant CD80 polypeptide of any of embodiments 82-84, wherein the multimerization domain is an Fc domain or a variant thereof with reduced effector function.

86. The variant CD80 polypeptide of any of embodiments 1-85 that is linked to a moiety that increases biological half-life of the polypeptide.

87. The variant CD80 polypeptide of any of embodiments 1-86 that is linked to an Fc domain or a variant thereof with reduced effector function.

88. The variant CD80 polypeptide of any of embodiments 85-87, wherein:

the Fc domain is mammalian, optionally human; or the variant Fc domain comprises one or more amino acid modifications compared to an umodified Fc domain that is mammalian, optionally human.

89. The variant CD80 polypeptide of any of embodiments 85-88, wherein the Fc domain or variant thereof comprises the sequence of amino acids set forth in SEQ ID NO:226 or SEQ ID NO:227 or a sequence of amino acids that exhibits at least 85% sequence identity to SEQ ID NO:226 or SEQ ID NO:227.

90. The variant CD80 polypeptide of any of embodiments 82-89, wherein the variant CD80 polypeptide is linked indirectly via a linker.

91. The variant CD80 polypeptide of any of embodiments 1-90, that is a transmembrane immunomodulatory protein further comprising a transmembrane domain linked to the extracellular domain (ECD) or specific binding fragment thereof of the variant CD80 polypeptide.

92. The variant CD80 polypeptide of embodiment 91, wherein the transmembrane domain comprises the sequence of amino acids set forth as residues 243-263 of SEQ ID NO: 1 or a functional variant thereof that exhibits at least 85% sequence identity to residues 243-263 of SEQ ID NO: 1.

93. The variant CD80 polypeptide of embodiment 91 or embodiment 92, further comprising a cytoplasmic domain linked to the transmembrane domain.

94. The variant CD80 polypeptide of embodiment 93, wherein the cytoplasmic domain comprises the sequence of amino acids set forth as residues 264-288 of SEQ ID NO: 1 or a functional variant thereof that exhibits at least 85% sequence identity to residues 264-288 of SEQ ID NO: 1.

95. The variant CD80 polypeptide of any of embodiments 1-94, wherein the variant CD80 increases IFN-gamma (interferon-gamma) expression relative to the unmodified CD80 in an in vitro primary T-cell assay.

96. The variant CD80 polypeptide of any of embodiments 1-95, wherein the variant CD80 decreases IFN-gamma (interferon-gamma) expression relative to the unmodified CD80 in an in vitro primary T-cell assay.

97. The variant CD80 polypeptide of any of embodiments 1-96 that is deglycosylated.

98. An immunomodulatory polypeptide, comprising the variant CD80 of any of embodiments 1-97 linked to a second polypeptide comprising an immunoglobulin superfamily (IgSF) domain.

99. The immunomodulatory polypeptide of embodiment 98, wherein the IgSF domain is affinity modified and exhibits altered binding to one or more of its cognate binding partner(s) compared to the unmodified or wild-type IgSF domain.

100. The immunomodulatory polypeptide of embodiment 99, wherein the IgSF domain exhibits increased binding to one or more of its cognate binding partner(s) compared to the unmodified or wild-type IgSF domain.

101. The immunomodulatory polypeptide of any of embodiments 98-100, wherein the variant CD80 is a first variant CD80 and the IgSF domain of the second polypeptide is an IgSF domain from a second variant CD80 of any of embodiments 1-97, wherein the first and second variant CD80 are the same or different.

102. The immunomodulatory protein of any of embodiments 98-101, wherein the variant CD80 polypeptide is capable of specifically binding to CD28, PD-L1, or CTLA-4, and the IgSF domain of the second polypeptide is capable of binding to a cognate binding partner other than one specifically bound by the variant CD80 polypeptide.

103. The immunomodulatory protein of any of embodiments 98-102, wherein the variant CD80 polypeptide is capable of specifically binding to CD28 or PD-L1, and the IgSF domain is capable of binding to a cognate binding partner other than one specifically bound by the variant CD80 polypeptide.

104. The immunomodulatory protein of any of embodiments 98-103, wherein the variant CD80 polypeptide is capable of specifically binding to CD28 or CTLA-4, and the IgSF domain is capable of binding to a cognate binding partner other than one specifically bound by the variant CD80 polypeptide.

105. The immunomodulatory protein any of embodiments 98-103, wherein the variant CD80 polypeptide is capable of specifically binding to CTLA-4 or PD-L1 and the IgSF domain is capable of binding to a cognate binding partner other than one specifically bound by the variant CD80 polypeptide.

106. The immunomodulatory polypeptide of any of embodiments 98-105, wherein the IgSF domain is from a member of the B7 family.

107. The immunomodulatory polypeptide of any of embodiments 82-90, wherein the IgSF domain is a tumor-localizing moiety that binds to a ligand expressed on a tumor.

108. The immunomodulatory polypeptide of embodiment 107, wherein the ligand is B7H6.

109. The immunomodulatory polypeptide of embodiment 107 or embodiment 108, wherein the IgSF domain is from NKp30.

110. The immunomodulatory polypeptide of any of embodiments 98-109, wherein the IgSF domain is affinity modified and exhibits increased binding to one or more of its cognate binding partner(s) compared to the unmodified or wild-type IgSF domain.

111. The immunomodulatory polypeptide of any of embodiments 98-110, wherein the IgSF domain is or comprises an IgV domain.

112. The immunomodulatory polypeptide of any of embodiments 98-111, wherein the variant CD80 polypeptide is or comprise an IgV domain.

113. The immunomodulatory protein of any of embodiments 98-112, wherein the immunomodulatory protein comprises a multimerization domain linked to one or both of the variant CD80 polypeptide and the second polypeptide comprising the IgSF domain.

114. The immunomodulatory protein of embodiment 113, wherein the multimerization domain is an Fc domain or a variant thereof with reduced effector function.

115. The immunomodulatory protein of any of embodiments 98-114 that is dimeric.

116. The immunomodulatory protein of embodiment 115 that is homodimeric.

117. The immunomodulatory protein of embodiment 115 that is heterodimeric.

118. A conjugate, comprising a variant CD80 of any of embodiments 1-98 or an immunomodulatory polypeptide of any of embodiments 99-117 linked to a moiety.

119. The conjugate of embodiment 118, wherein the moiety is a targeting moiety that specifically binds to a molecule on the surface of a cell.

120. The conjugate of embodiment 119, wherein the targeting moiety specifically binds to a molecule on the surface of an immune cell.

121. The conjugate of embodiment 120, wherein the immune cell is an antigen presenting cell or a lymphocyte.

122. The conjugate of embodiment 119, wherein the targeting moiety is a tumor-localizing moiety that binds to a molecule on the surface of a tumor.

123. The conjugate of any of embodiments 118-122, wherein the moiety is a protein, a peptide, nucleic acid, small molecule or nanoparticle.

124. The conjugate of any of embodiments 118-123, wherein the moiety is an antibody or antigen-binding fragment.

125. The conjugate of any of embodiments 118-124, wherein the conjugate is divalent, tetravalent, hexavalent or octavalent.

126. A nucleic acid molecule(s) encoding the variant CD80 polypeptide of any of embodiments 1-98 or the immunomodulatory polypeptide of any of embodiments 99-117.

127. The nucleic acid molecule of embodiment 126 that is synthetic nucleic acid.

128. The nucleic acid molecule of embodiment 126 or embodiment 127 that is cDNA.

129. A vector, comprising the nucleic acid molecule of any of embodiments 125-128.

130. The vector of embodiment 129 that is an expression vector.

131. The vector of embodiments 129 or embodiment 130, wherein the vector is a mammalian vector or a viral vector.

132. A cell comprising the vector of any of embodiments 129-131.

133. The cell of embodiment 132 that is a mammalian cell.

134. The cell of embodiment 133 that is a human cell.

135. A method of producing a variant CD80 polypeptide or an immunomodulatory protein, comprising introducing the nucleic acid molecule of any of embodiments 125-128 or vector of any of embodiments 129-131 into a host cell under conditions to express the protein in the cell.

136. The method of embodiment 135, further comprising isolating or purifying the variant CD80 polypeptide or immunomodulatory protein from the cell.

137. A method of engineering a cell expressing a variant CD80 polypeptide, comprising introducing a nucleic acid molecule encoding the variant CD80 polypeptide of any of embodiments 1-98 into a host cell under conditions in which the polypeptide is expressed in the cell.

138. An engineered cell, expressing the variant CD80 polypeptide of any of embodiments 1-98, the immunomodulatory protein of any of embodiments 99-117, the nucleic acid molecule of any of embodiments 125-128 or the vector of any of embodiments 129-131.

139. The engineered cell of embodiment 138, wherein the variant CD80 polypeptide or immunomodulatory polypeptide comprises a signal peptide.

140. The engineered cell of embodiment 138 or embodiment 139, wherein the variant CD80 polypeptide or immunomodulatory polypeptide does not comprise a transmembrane domain and/or is not expressed on the surface of the cell.

141. The engineered cell of any of embodiments 138-140, wherein the variant CD80 polypeptide or immunomodulatory polypeptide is secreted from the engineered cell.

142. The engineered cell of embodiment 138 or embodiment 139, wherein the engineered cell comprises a variant CD80 polypeptide that comprises a transmembrane domain and/or is the transmembrane immunomodulatory protein of any of embodiments 91-97.

143. The engineered cell of embodiment 138, embodiment 139 or embodiment 142, wherein the variant CD80 polypeptide is expressed on the surface of the cell.

144. The engineered cell of any of embodiments 138-143, wherein the cell is an immune cell.

145. The engineered cell of embodiment 144, wherein the immune cell is an antigen presenting cell (APC) or a lymphocyte.

146. The engineered cell of any of embodiments 138-145 that is a primary cell.

147. The engineered cell of any of embodiments 138-146, wherein the cell is a mammalian cell.

148. The engineered cell of any of embodiments 138-147, wherein the cell is a human cell.

149. The engineered cell of any of embodiments 145-148, wherein the lymphocyte is a T cell.

150. The engineered cell of any one of embodiments 145-149, wherein the APC is an artificial APC.

151. The engineered cell of any of embodiments 138-150, further comprising a chimeric antigen receptor (CAR) or an engineered T-cell receptor.

152. An infectious agent, comprising a nucleic acid molecule encoding a variant CD80 polypeptide of any of embodiments 1-97 or an immunomodulatory polypeptide of any of embodiments 98-117.

153. The infectious agent of embodiment 152, wherein the encoded variant CD80 polypeptide or immunomodulatory polypeptide does not comprise a transmembrane domain and/or is not expressed on the surface of a cell in which it is expressed.

154. The infectious agent of embodiment 152 or embodiment 153, wherein the encoded variant COD80 polypeptide or immunomodulatory polypeptide is secreted from a cell in which it is expressed.

155. The infectious agent of embodiment 152, wherein the encoded variant CD80 polypeptide comprises a transmembrane domain.

156. The infectious agent of embodiment 152 or embodiment 155, wherein the encoded variant CD80 polypeptide is expressed on the surface of a cell in which it is expressed.

157. The infectious agent of any of embodiments 152-156, wherein the infectious agent is a bacterium or a virus.

158. The infectious agent of embodiment 157, wherein the virus is an oncolytic virus.

159. The infectious agent of embodiment 158, wherein the oncolytic virus is an adenoviruses, adeno-associated viruses, herpes viruses, Herpes Simplex Virus, Vesticular Stomatic virus, Reovirus, Newcastle Disease virus, parvovirus, measles virus, vesticular stomatitis virus (VSV), Coxsackie virus or a Vaccinia virus.

160. The infectious agent of embodiment 159, wherein the virus specifically targets dendritic cells (DCs) and/or is dendritic cell-tropic.

161. The infectious agent of embodiment 160, wherein the virus is a lentiviral vector that is pseudotyped with a modified Sindbis virus envelope product.

162. The infectious agent of any of embodiments 152-161, further comprising a nucleic acid molecule encoding a further gene product that results in death of a target cell or that can augment or boost an immune response.

163. The infectious agent of embodiment 162, wherein the further gene product is selected from an anticancer agent, anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic gene product, a cell matrix degradative gene, genes for tissue regeneration or a reprogramming human somatic cells to pluripotency.

164. A pharmaceutical composition, comprising the variant CD80 polypeptide of any of embodiments 1-97, the immunomodulatory protein of any of embodiments 98-117, the conjugate of any of embodiments 118-125, the engineered cell of any of embodiments 138-151 or the infectious agent of any of embodiments 152-163.

165. The pharmaceutical composition of embodiment 164, comprising a pharmaceutically acceptable excipient.

166. The pharmaceutical composition of embodiment 164 or 165, wherein the pharmaceutical composition is sterile.

167. An article of manufacture comprising the pharmaceutical composition of any of embodiments 164-166 in a vial.

168. The article of manufacture of embodiment 167, wherein the vial is sealed.

169. A kit comprising the pharmaceutical composition of any of embodiments 164-166, and instructions for use.

170. A kit comprising the article of manufacture according to embodiment 167 and 168, and instructions for use.

171. A method of modulating an immune response in a subject, comprising administering the pharmaceutical composition of any of embodiments 164-166 to the subject.

172. A method of modulating an immune response in a subject, comprising administering the engineered cells of any of embodiments 138-151.

173. The method of embodiment 172, wherein the engineered cells are autologous to the subject.

174. The method of embodiment 172, wherein the engineered cells are allogenic to the subject.

175. The method of any of embodiments 171-174, wherein modulating the immune response treats a disease or condition in the subject.

176. The method of any of embodiments 171-175, wherein the immune response is increased.

177. The method of any of embodiments 171, 175 and 176, wherein an immunomodulatory protein or conjugate comprising a variant CD80 polypeptide linked to a tumor-localizing moiety is administered to the subject.

178. The method of embodiment 177, wherein the tumor-localizing moiety is or comprises a binding molecule that recognizes a tumor antigen.

179. The method of embodiment 178, wherein the binding molecule comprises an antibody or an antigen-binding fragment thereof or comprises a wild-type IgSF domain or variant thereof.

180. The method of any of embodiments 171 and 175-179, wherein a pharmaceutical composition comprising the immunomodulatory protein of any of embodiments 107-117 or the conjugate of any of embodiments 118-125 is administered to the subject.

181. The method of any of embodiments 172-176, wherein an engineered cell comprising a variant CD80 polypeptide that is a transmembrane immunomodulatory protein is administered to the subject and/or the engineered cell of 138, 139 and 142-151 is administered to the subject.

182. The method of any of embodiments 171, 175 and 176, wherein an infectious agent encoding a variant CD80 polypeptide that is a transmembrane immunomodulatory protein is administered to the subject, optionally under conditions in which the infectious agent infects a tumor cell or immune cell and the transmembrane immunomodulatory protein is expressed on the surface of the infected cell.

183. The method of any of embodiment 181 or embodiment 182, wherein the transmembrane immunomodulatory protein is of any of embodiments 91-97.

184. The method of any of embodiments 171-183, wherein the disease or condition is a tumor or cancer.

185. The method of any one of embodiments 171-184, wherein the disease or condition is selected from melanoma, lung cancer, bladder cancer, a hematological malignancy, liver cancer, brain cancer, renal cancer, breast cancer, pancreatic cancer, colorectal cancer, spleen cancer, prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer.

186. The method of any of embodiments 171-175, wherein the immune response is decreased.

187. The method of any of embodiments 171, 175 and 186, wherein a variant CD80 polypeptide or immunomodulatory protein that is soluble is administered to the subject.

188. The method of embodiment 187, wherein the soluble polypeptide or immunomodulatory protein is an Fc fusion protein.

189. The method of any of embodiments 171, 175 and 186-188, wherein a pharmaceutical composition comprising a variant CD80 polypeptide of any of embodiments 1-90 and 95-97, or the immunomodulatory protein of any of embodiments 98-106 and 111-117 is administered to the subject.

190. The method of any of embodiments 172-175 and 186, wherein an engineered cell comprising a secretable variant CD80 polypeptide is administered to the subject.

191. The method of any of embodiments 172-175 and 186-188, wherein an engineered cell of any of embodiments 138-141 and 144-151 is administered to the subject.

192. The method of any of embodiments 171, 175 and 186-188, wherein an infectious agent encoding a variant CD80 polypeptide that is a secretable immunomodulatory protein is administered to the subject, optionally under conditions in which the infectious agent infects a tumor cell or immune cell and the secretable immunomodulatory protein is secreted from the infected cell.

193. The method of any of embodiments 171-175 and 186-192, wherein the disease or condition is an inflammatory or autoimmune disease or condition.

194. The method of any of embodiments 171-175 and 186-193, wherein the disease or condition is an Antineutrophil cytoplasmic antibodies (ANCA)-associated vasculitis, a vasculitis, an autoimmune skin disease, transplantation, a Rheumatic disease, an inflammatory gastrointestinal disease, an inflammatory eye disease, an inflammatory neurological disease, an inflammatory pulmonary disease, an inflammatory endocrine disease, or an autoimmune hematological disease.

195. The method of embodiment 193 or embodiment 194, wherein the disease or condition is selected from inflammatory bowel disease, transplant, Crohn's disease, ulcerative colitis, multiple sclerosis, asthma, rheumatoid arthritis, or psoriasis.

IX. EXAMPLES

The following examples are included for illustrative purposes only and are not intended to limit the scope of the invention.

Example 1

Generation of Mutant DNA Constructs of IgSF Domains

Example 1 describes the generation of mutant DNA constructs of human CD80 IgSF domains for translation and expression on the surface of yeast as yeast display libraries.

A. Degenerate Libraries

Constructs were generated based on a wildtype human CD80 amino acid sequence of the extracellular domain (ECD) set forth in SEQ ID NO: 28 (corresponding to residues 35-242 as set forth in UniProt Accession No. P33681) as follows:

```
VIHVTKEVKEVATLSCGHNVSVEELAQTRIYWQKEKKMVLTMMSGDMNIW

PEYKNRTIFDITNNLSIVILALRPSDEGTYECVVLKYEKDAFKREHLAEV

TLSVKADFPTPSISDFEIPTSNIRRIICSTSGGFPEPHLSWLENGEELNA
```

-continued

INTTVSQDPETELYAVSSKLDFNMTTNHSFMCLIKYGHLRVNQTFNWNTT

KQEHFPDN

For libraries that target specific residues for complete or partial randomization with degenerate codons, the DNAencoding SEQ ID NO: 28 was ordered from Integrated DNA Technologies (Coralville, Iowa) as a set of overlapping oligonucleotides of up to 80 base pairs (bp) in length. To generate a library of diverse variants of the ECD, the oligonucleotides contained desired degenerate codons at desired amino acid positions. Degenerate codons were generated using an algorithm at the URL: rosettadesign.med.unc.edu/SwiftLib/.

In general, positions to mutate and degenerate codons were chosen from crystal structures of the target-ligand pairs of interest to identify ligand contact residues as well as residues that are at the protein interaction interface. This analysis was performed using a structure viewer available at the URL:spdbv.vital-it.ch). For example, a crystal structure for CD80 bound to CTLA-4 is publicly available at the URL:www.rcsb.org/pdb/explore/explore.do?structureId=1I8L) and a targeted library was designed based on the CD80::CTLA-4 interface for selection of improved binders to CTLA-4. However, there are no CD80 structures available with ligands CD28 and PDL1, so the same library was also used to select for binders of CD28 (binds the same region on CD80 as CTLA-4) and PDL1 (not known if PDL1 binds the same site as CTLA-4).

The next step in library design was the alignment of human, mouse, rat and monkey CD80 sequences to identify conserved residues. Based on this analysis, conserved target residues were mutated with degenerate codons that only specified conservative amino acid changes plus the wild-type residue. Residues that were not conserved were mutated more aggressively, but also included the wild-type residue. Degenerate codons that also encoded the wild-type residue were deployed to avoid excessive mutagenesis of target protein. For the same reason, only up to 20 positions were targeted for mutagenesis at a time. These residues were a combination of contact residues and non-contact interface residues.

The oligonucleotides were dissolved in sterile water, mixed in equimolar ratios, heated to 95° C. for five minutes and slowly cooled to room temperature for annealing. ECD-specific oligonucleotide primers that anneal to the start and end of the ECDs, respectively, were then used to generate PCR product. ECD-specific oligonucleotides which overlap by 40-50 bp with a modified version of pBYDS03 cloning vector (Life Technologies USA), beyond and including the BamH1 and Kpn1 cloning sites, were then used to amplify 100 ng of PCR product from the prior step to generate a total of 5 μg of DNA. Both polymerase chain reactions (PCRs) were conducted using OneTaq 2×PCR master mix (New England Biolabs, USA). The products from the second PCR were purified using a PCR purification kit (Qiagen, Germany) and resuspended in sterile deionized water.

To prepare for library insertion, a modified yeast display version of vector pBYDS03 was digested with BamH1 and Kpn1 restriction enzymes (New England Biolabs, USA) and the large vector fragment was gel-purified and dissolved in sterile, deionized water. Electroporation-ready DNA for the next step was generated by mixing 12 μg of library DNA with 4 μg of linearized vector in a total volume of 50 μl deionized and sterile water. An alternative way to generate targeted libraries was to carry out site-directed mutagenesis (Multisite kit, Agilent, USA) of the target ECD with oligonucleotides containing degenerate codons. This approach was used to generate sublibraries that only target specific stretches of target protein for mutagenesis. In these cases, sublibraries were mixed before proceeding to the selection steps. In general, library sizes were in the range of 10E7 to 10E8 clones, except that sublibraries were only in the range of 10E4 to 10E5. Large libraries and sublibraries were generated for ICOSL.

B. Random Libraries

Random libraries were also constructed to identify variants of the ECD of CD80 set forth in SEQ ID NO: 28 (containing the IgV domain, corresponding to residues 35-135 as set forth in UniProt Accession No. P33681, flanked by adjacent C-terminal residues of the wildtype sequence). DNA encoding the wild-type ECD was cloned between the BamH1 and Kpn1 sites of modified yeast display vector pBYDS03 and then released using the same restriction enzymes. The released DNA was then mutagenized with the Genemorph II kit (Agilent, USA) to generate an average of three to five amino acid changes per library variant. Mutagenized DNA was then amplified by the two-step PCR, and further processed, as described above for targeted libraries.

Example 2

Introduction of DNA Libraries into Yeast

Example 2 describes the introduction of CD80 DNA libraries into yeast. To introduce degenerate and random library DNA into yeast, electroporation-competent cells of yeast strain BJ5464 (ATCC.org; ATCC number 208288) were prepared and electroporated on a Gene Pulser II (Biorad, USA) with the electroporation-ready DNA from the step above essentially as described (Colby, D. W. et al. 2004 Methods Enzymology 388, 348-358). The only exception was that transformed cells were grown in non-inducing minimal selective SCD-Leu medium to accommodate the LEU2 selective marker carried by modified plasmid pBYDS03.

Library size was determined by plating dilutions of freshly recovered cells on SCD-Leu agar plates and then extrapolating library size from the number of single colonies from plating that generated at least 50 colonies per plate. The remainder of the electroporated culture was grown to saturation and cells from this culture were subcultured into the same medium once more to minimize the fraction of untransformed cells. To maintain library diversity, this subculturing step was carried out using an inoculum that contained at least 10× more cells than the calculated library size. Cells from the second saturated culture were resuspended in fresh medium containing sterile 25% (weight/volume) glycerol to a density of 10E10/ml and frozen and stored at −80° C. (frozen library stock).

One liter of SCD-Leu media consisted of 14.7 grams of sodium citrate, 4.29 grams of citric acid monohydrate, 20 grams of dextrose, 6.7 grams of Difco brand yeast nitrogen base, and 1.6 grams yeast synthetic drop-out media supplement without leucine. Media was filtered sterilized before use, using a 0.2 μM vacuum filter device.

Library size was determined by plating dilutions of freshly recovered cells on SCD-Leu agar plates and then extrapolating library size from the number of single colonies from a plating that generate at least 50 colonies per plate.

To segregate plasmid from cells that contain two or more different library clones, a number of cells corresponding to 10 times the library size, were taken from the overnight SCD-Leu culture and subcultured 1/100 into fresh SCD-Leu medium and grown overnight. Cells from this overnight culture were resuspended in sterile 25% (weight/volume) glycerol to a density of 10E10/ml and frozen and stored at −80C (frozen library stock).

Example 3

Yeast Selection

Example 3 describes the selection of yeast expressing affinity modified variants of CD80. A number of cells equal to at least 10 times the library size were thawed from individual library stocks, suspended to 0.1×10E6 cells/ml in non-inducing SCD-Leu medium, and grown overnight. The next day, a number of cells equal to 10 times the library size were centrifuged at 2000 RPM for two minutes and resuspended to 0.5×10E6 cells/ml in inducing SCDG-Leu media. One liter of the SCDG-Leu induction media consists of 5.4 grams $Na_2HPO_4$, 8.56 grams of $NaH_2PO_4$*$H_2O$, 20 grams galactose, 2.0 grams dextrose, 6.7 grams Difco yeast nitrogen base, and 1.6 grams of yeast synthetic drop out media supplement without leucine dissolved in water and sterilized through a 0.22 am membrane filter device. The culture was grown for two days at 20° C. to induce expression of library proteins on the yeast cell surface.

Cells were processed with magnetic beads to reduce non-binders and enrich for all variant CD80 polypeptides with the ability to bind their exogenous recombinant counter-structure proteins. For example, yeast displayed targeted or random CD80 libraries were selected against each of CD28, CTLA-4 and PD-L1 separately. This was then followed by two to three rounds of flow cytometry sorting using exogenous counter-structure protein staining to enrich the fraction of yeast cells that displays improved binders. Magnetic bead enrichment and selections by flow cytometry are essentially as described in Keith D. Miller, 1 Noah B. Pefaur, 2 and Cheryl L. Bairdl Current Protocols in Cytometry 4.7.1-4.7.30, July 2008.

With CD80 libraries, target ligand proteins were sourced from R&D Systems (USA) as follows: human rCD28.Fc (i.e., recombinant CD28-Fc fusion protein), rPDL1.Fc and rCTLA4.Fc. Magnetic streptavidin beads were obtained from New England Biolabs, USA. For biotinylation of counter-structure protein, biotinylation kit cat #21955, Life Technologies, USA, was used. For two-color, flow cytometric sorting, a Becton Dickinson FACS Aria II sorter was used. CD80 display levels were monitored with an anti-hemagglutinin (anti-HA) antibody labeled with Alexafluor 488 (Life Technologies, USA). Ligand binding Fc fusion proteins rCD28.Fc, rCTLA4.Fc and rPDL1.Fc were detected with PE conjugated human Ig specific goat Fab (Jackson ImmunoResearch, USA). Doublet yeast were gated out using forward scatter (FSC)/side scatter (SSC) parameters, and sort gates were based upon higher ligand binding detected in FL4 that possessed more limited tag expression binding in FL1.

Yeast outputs from the flow cytometric sorts were assayed for higher specific binding affinity. Sort output yeast were expanded and re-induced to express the particular IgSF affinity modified domain variants they encode. This population then can be compared to the parental, wild-type yeast strain, or any other selected outputs, such as the bead output yeast population, by flow cytometry.

Importantly, the MFIs of all F2 outputs described above when measured with the anti-HA tag antibody on FL1 did not increase and sometimes went down compared to wild-type strains, indicating that increased binding was not a function of increased expression of the selected variants on the surface of yeast, and validated gating strategies of only selecting mid to low expressors with high ligand binding.

Selected variant CD80 ECD domains were further formatted as fusion proteins and tested for binding and functional activity as described below.

Example 4

Reformatting Selection Outputs as Fc-Fusions and in Various Immunomodulatory Protein Types Example 4 describes reformatting of selection outputs as immunomodulatory proteins containing an affinity modified (variant) extracellular domain (ECD) of CD80 fused to an Fc molecule (variant ECD-Fc fusion molecules).

Output cells from final flow cytometric CD80 sorts were grown to terminal density in SCD-Leu medium. Plasmid DNAs from each output were isolated using a yeast plasmid DNA isolation kit (Zymoresearch, USA). For Fc fusions, PCR primers with added restriction sites suitable for cloning into the Fc fusion vector of choice were used to batch-amplify from the plasmid DNA preps the coding DNA's for the mutant target ECD's. After restriction digestion, the PCR products were ligated into an appropriate Fc fusion vector followed by chemical transformation into strain XL1 Blue *E. Coli* (Agilent, USA) or NEB5alpha (New England Biolabs) as directed by supplier. An example of an Fc fusion vector is pFUSE-hIgG1-Fc2 (Invivogen, USA).

Dilutions of transformation reactions were plated on LB-agar containing 100 μg/ml carbenicillin (Teknova, USA) to generate single colonies. Up to 96 colonies from each transformation were then grown in 96 well plates to saturation overnight at 37° C. in LB-broth (Teknova cat #L8112) and a small aliquot from each well was submitted for DNA sequencing of the ECD insert in order to identify the mutation(s) in all clones. Sample preparation for DNA sequencing was carried out using protocols provided by the service provider (Genewiz; South Plainfield, N.J.). After removal of sample for DNA sequencing, glycerol was then added to the remaining cultures for a final glycerol content of 25% and plates were stored at −20° C. for future use as master plates (see below). Alternatively, samples for DNA sequencing were generated by replica plating from grown liquid cultures to solid agar plates using a disposable 96 well replicator (VWR, USA). These plates were incubated overnight to generate growth patches and the plates were submitted to Genewiz as specified by Genewiz. In some instances, resequencing was performed to verify mutations.

After identification of clones of interest from analysis of Genewiz-generated DNA sequencing data, clones of interest were recovered from master plates and individually grown to density in 5 ml liquid LB-broth containing 100 μg/ml carbenicillin (Teknova, USA) and 2 ml of each culture were then used for preparation of approximately 10 μg of miniprep plasmid DNA of each clone using a standard kit such as the Pureyield kit (Promega). Identification of clones of interest generally involved the following steps. First, DNA sequence data files were downloaded from the Genewiz website. All sequences were then manually curated so that they start at the beginning of the ECD coding region. The curated sequences were then batch-translated using a suitable program available at the URL: www.ebi.ac.uk/Tools/st/emboss_transeq/. The translated sequences were then aligned using a suitable program available at the URL: multalin.toulouse.inra.fr/multalin/multalin.html.

Clones of interest were then identified using the following criteria: 1) identical clone occurs at least two times in the alignment and 2) a mutation occurs at least two times in the alignment and preferably in distinct clones. Clones that meet at least one of these criteria were clones that have been enriched by the sorting process due to improved binding.

To generate immunomodulatory proteins that were Fc fusion proteins containing an ECD of CD80 with at least one affinity-modified domain, the encoding nucleic acid molecule was generated to encode a protein designed as follows: variant (mutant) ECD followed by a linker of three alanines (AAA) followed by a human IgG1 Fc containing the mutations R77C, N82G and V87C with reference to wild-type human IgG1 Fc set forth in SEQ ID NO: 226. Since the construct does not include any antibody light chains that can form a covalent bond with a cysteine, the human IgG1 Fc also contains replacement of the cysteine residues to a serine residue at position 5 (C5S) compared to the wild-type or unmodified Fc set forth in SEQ ID NO: 226.

Example 5

Expression and Purification of Fc-Fusions

Example 5 describes the high throughput expression and purification of Fc-fusion proteins containing variant ECD CD80.

Recombinant variant Fc fusion proteins were produced with Expi293 expression system (Invitrogen, USA). 4 μg of each plasmid DNA from the previous step was added to 200 μl Opti-MEM (Invitrogen, USA) at the same time as 10.81 μl ExpiFectamine was separately added to another 200 μl Opti-MEM. After 5 minutes, the 200 μl of plasmid DNA was mixed with the 200 μl of ExpiFectamine and was further incubated for an additional 20 minutes before adding this mixture to cells. Ten million Expi293 cells were dispensed into separate wells of a sterile 10 ml, conical bottom, deep 24-well growth plate (Thomson Instrument Company, USA) in a volume of 3.4 ml Expi293 media (Invitrogen, USA). Plates were shaken for 5 days at 120 RPM in a mammalian cell culture incubator set to 95% humidity and 8% $CO_2$. Following a 5-day incubation, cells were pelleted and culture supernatants were removed.

Protein was purified from supernatants using a high throughput 96-well Protein A purification kit using the manufacturer's protocol (Catalog number 45202, Life Technologies, USA). Resulting elution fractions were buffer exchanged into PBS using Zeba 96-well spin desalting plate (Catalog number 89807, Life Technologies, USA) using the manufacturer's protocol. Purified protein was quantitated using 280 nm absorbance measured by Nanodrop instrument (Thermo Fisher Scientific, USA), and protein purity was assessed by loading 5 μg of protein on NUPAGE pre-cast, polyacrylamide gels (Life Technologies, USA) under denaturing and reducing conditions and subsequent gel electrophoresis. Proteins were visualized in gel using standard Coomassie staining.

Example 6

Assessment of Binding and Activity of Affinity-Matured IgSF Domain-Containing Molecules A. Binding to Cell-Expressed Counter Structures This Example describes Fc-fusion binding studies to show specificity and affinity of CD80 domain variant immunomodulatory proteins for cognate binding partners.

To produce cells expressing cognate binding partners, full-length mammalian surface expression constructs for each of human CD28, CTLA-4 and PD-L1, were designed in pcDNA3.1 expression vector (Life Technologies) and sourced from Genscript, USA. Binding studies were carried out using the Expi293F transient transfection system (Life Technologies, USA). The number of cells needed for the experiment was determined, and the appropriate 30 ml scale of transfection was performed using the manufacturer's suggested protocol. For each CD28, CTLA-4, PD-L1, or mock 30 ml transfection, 75 million Expi293F cells were incubated with 30 μg expression construct DNA and 1.5 ml diluted ExpiFectamine 293 reagent for 48 hours, at which point cells were harvested for staining.

For staining by flow cytometry, 200,000 cells of appropriate transient transfection or negative control were plated in 96-well round bottom plates. Cells were spun down and resuspended in staining buffer (PBS (phosphate buffered saline), 1% BSA (bovine serum albumin), and 0.1% sodium azide) for 20 minutes to block non-specific binding. Afterwards, cells were centrifuged again and resuspended in staining buffer containing 100 nM to 1 nM variant immunomodulatory protein, depending on the experiment of each candidate variant CD80 Fc protein in 50 l. Primary staining was performed on ice for 45 minutes, before washing cells in staining buffer twice. PE-conjugated anti-human Fc (Jackson ImmunoResearch, USA) was diluted 1:150 in 50 μl staining buffer and added to cells and incubated another 30 minutes on ice. Secondary antibody was washed out twice, cells were fixed in 4% formaldehyde/PBS, and samples were analyzed on FACScan flow cytometer (Becton Dickinson, USA).

Mean Fluorescence Intensity (MFI) was calculated for each transfectant and negative parental line with Cell Quest Pro software (Becton Dickinson, USA).

B. Bioactivity Characterization

This Example further describes Fc-fusion variant protein bioactivity characterization in human primary T cell in vitro assays.

1. Mixed Lymphocyte Reaction (MLR)

Soluble rCD80.Fc bioactivity was tested in a human Mixed Lymphocyte Reaction (MLR). Human primary dendritic cells (DC) were generated by culturing monocytes isolated from PBMC (BenTech Bio, USA) in vitro for 7 days with 500 U/ml rIL-4 (R&D Systems, USA) and 250 U/ml rGM-CSF (R&D Systems, USA) in Ex-Vivo 15 media (Lonza, Switzerland). 10,000 matured DC and 100,000 purified allogeneic CD4+ T cells (BenTech Bio, USA) were co-cultured with variant CD80 Fc fusion proteins and controls in 96 well round bottom plates in 200 μl final volume of Ex-Vivo 15 media. On day 5, IFN-gamma secretion in culture supernatants was analyzed using the Human IFN-gamma Duoset ELISA kit (R&D Systems, USA). Optical density was measured by VMax ELISA Microplate Reader (Molecular Devices, USA) and quantitated against titrated rIFN-gamma standard included in the IFN-gamma Duo-set kit (R&D Systems, USA).

2. Anti-CD3 Coimmobilization Assay

Costimulatory bioactivity of CD80 fusion variants was determined in anti-CD3 coimmobilization assays. 1 nM or 4 nM mouse anti-human CD3 (OKT3, Biolegends, USA) was diluted in PBS with 1 nM to 80 nM rCD80.Fc variant proteins. This mixture was added to tissue culture treated flat bottom 96-well plates (Corning, USA) overnight to facilitate adherence of the stimulatory proteins to the wells of the plate. The next day, unbound protein was washed off the plates and 100,000 purified human pan T cells (BenTech Bio, US) or human T cell clone BC3 (Astarte Biologics, USA) were added to each well in a final volume of 200 µl of Ex-Vivo 15 media (Lonza, Switzerland). Cells were cultured 3 days before harvesting culture supernatants and measuring human IFN-gamma levels with Duoset ELISA kit (R&D Systems, USA) as described above.

C. Results

Results for the binding and activity studies for exemplary tested variants are shown in Tables 7 and 8. In particular, Table 7 indicates exemplary IgSF domain amino acid substitutions (replacements) in the ECD of CD80 selected in the screen for affinity-maturation against the respective cognate structure CD28. Table 8 indicates exemplary IgSF domain amino acid substitutions (replacements) in the ECD of CD80 selected in the screen for affinity-maturation against the respective cognate structure PD-L1. For the Tables, the exemplary amino acid substitutions are designated by amino acid position number corresponding to the respective reference unmodified ECD sequence. For example, the reference unmodified ECD sequence in Tables 7 and 8 is the unmodified CD80 ECD sequence set forth in SEQ ID NO:28. The amino acid position is indicated in the middle, with the corresponding unmodified (e.g. wild-type) amino acid listed before the number and the identified variant amino acid substitution listed after the number. Column 2 sets forth the SEQ ID NO identifier for the variant ECD for each variant ECD-Fc fusion molecule.

Also shown is the binding activity as measured by the Mean Fluorescence Intensity (MFI) value for binding of each variant Fc-fusion molecule to cells engineered to express the cognate counter structure ligand and the ratio of the MFI compared to the binding of the corresponding unmodified ECD-Fc fusion molecule not containing the amino acid substitution(s) to the same cell-expressed counter structure ligand. The functional activity of the variant Fc-fusion molecules to modulate the activity of T cells also is shown based on the calculated levels of IFN-gamma in culture supernatants (pg/ml) generated either i) with the indicated variant ECD-Fc fusion molecule coimmoblized with anti-CD3 or ii) with the indicated variant ECD-Fc fusion molecule in an MLR assay. Tables 7 and Table 8 also depict the ratio of IFN-gamma produced by each variant ECD-Fc compared to the corresponding unmodified ECD-Fc in both functional assays.

As shown, the selections resulted in the identification of a number of CD80 IgSF domain variants that were affinity-modified to exhibit increased binding for at least one, and in some cases more than one, cognate counter structure ligand. In addition, the results showed that affinity modification of the variant molecules also exhibited improved activities to both increase and decrease immunological activity depending on the format of the molecule. For example, coimmobilization of the ligand likely provides a multivalent interaction with the cell to cluster or increase the avidity to favor agonist activity and increase T cell activation compared to the unmodified (e.g. wildtype) ECD-Fc molecule not containing the amino acid replacement(s). However, when the molecule is provided as a bivalent Fc molecule in solution, the same IgSF domain variants exhibited an antagonist activity to decrease T cell activation compared to the unmodified (e.g. wildtype) ECD-Fv molecule not containing the amino acid replacement(s).

TABLE 7

Variant CD80 selected against CD28. Molecule sequences, binding data, and costimulatory bioactivity data.

| CD80 mutation(s) | SEQ ID NO (ECD) | CD28 MFI (parental ratio) | Binding CTLA-4 MFI (parental ratio) | PD-L1 MFI (parental ratio) | Coimmobilization with anti-CD3 IFN-gamma pg/ml (parental ratio) | MLR IFN-gamma levels pg/ml (parental ratio) |
|---|---|---|---|---|---|---|
| L70Q/A91G/N144D | 414 | 125 (1.31) | 283 (1.36) | 6 (0.08) | 93 (1.12) | 716 (0.83) |
| L70Q/A91G/T130A | 56 | 96 (1.01) | 234 (1.13) | 7 (0.10) | 99 (1.19) | 752 (0.87) |
| L70Q/A91G/I118A/T120S/T130A/K169E | 415 | 123 (1.29) | 226 (1.09) | 7 (0.10) | 86 (1.03) | 741 (0.86) |
| V4M/L70Q/A91G/I118V/T120S/T130A/K169E | 416 | 89 (0.94) | 263 (1.26) | 6 (0.09) | 139 (1.67) | 991 (1.14) |
| L70Q/A91G/I118V/T120S/T130A/K169E | 417 | 106 (1.12) | 263 (1.26) | 6 (0.09) | 104 (1.25) | 741 (0.86) |
| V20L/L70Q/A91S/I118V/T120S/T130A | 419 | 105 (1.11) | 200 (0.96) | 9 (0.13) | 195 (2.34) | 710 (0.82) |
| S44P/L70Q/A91G/T130A | 61 | 88 (0.92) | 134 (0.64) | 5 (0.07) | 142 (1.71) | 854 (0.99) |
| L70Q/A91G/E117G/I118V/T120S/T130A | 420 | 120 (1.27) | 193 (0.93) | 6 (0.08) | 98 (1.05) | 736 (0.85) |
| A91G/T120S/I118V/T130A | 421 | 84 (0.89) | 231 (1.11) | 44 (0.62) | 276 (3.33) | 714 (0.82) |
| L70R/A91G/I118V/T120S/T130A/T199S | 422 | 125 (1.32) | 227 (1.09) | 6 (0.09) | 105 (1.26) | 702 (0.81) |
| L70Q/E81A/A91G/I118V/T120S/I127T/T130A | 423 | 140 (1.48) | 185 (0.89) | 18 (0.25) | 98 (1.18) | 772 (0.89) |

TABLE 7-continued

Variant CD80 selected against CD28. Molecule sequences, binding data, and costimulatory bioactivity data.

| CD80 mutation(s) | SEQ ID NO (ECD) | CD28 MFI (parental ratio) | Binding CTLA-4 MFI (parental ratio) | PD-L1 MFI (parental ratio) | Coimmobilization with anti-CD3 IFN-gamma pg/ml (parental ratio) | MLR IFN-gamma levels pg/ml (parental ratio) |
|---|---|---|---|---|---|---|
| L70Q/Y87N/A91G/T130A | 66 | 108 (1.13) | 181 (0.87) | 6 (0.08) | 136 (1.63) | 769 (0.89) |
| T28S/L70Q/A91G/E95K/I118V/T120S/I126V/T130A/K169E | 424 | 32 (0.34) | 65 (0.31) | 6 (0.08) | 120 (1.44) | 834 (0.96) |
| N63S/L70Q/A91G/S114T/I118V/T120S/T130A | 425 | 124 (1.30) | 165 (0.79) | 6 (0.08) | 116 (1.39) | 705 (0.81) |
| K36E/167T/L70Q/A91G/I118V/T120S/T130A/N152T | 426 | 8 (0.09) | 21 (0.10) | 5 (0.08) | 53 (0.63) | 852 (0.98) |
| E52G/L70Q/A91G/D107N/I118V/T120S/T130A/K169E | 427 | 113 (1.19) | 245 (1.18) | 6 (0.08) | 94 (1.13) | 874 (1.01) |
| K37E/F59S/L70Q/A91G/T120S/T130A | 428 | 20 (0.21) | 74 (0.36) | 6 (0.08) | 109 (1.31) | 863 (1.00) |
| A91G/S103P | 72 | 39 (0.41) | 56 (0.27) | 9 (0.13) | 124 (1.49) | 670 (0.77) |
| K89E/T130A | 73 | 90 (0.95) | 148 (0.71) | 75 (1.07) | 204 (2.45) | 761 (0.88) |
| A91G | 74 | 96 (1.01) | 200 (0.96) | 85 (1.21) | 220 (2.65) | 877 (1.01) |
| D60V/A91G/I118V/T120S/T130A/K169E | 429 | 111 (1.17) | 222 (1.07) | 12 (0.18) | 120 (1.44) | 744 (0.86) |
| K54M/L70Q/A91G/Y164H | 430 | 68 (0.71) | 131 (0.63) | 5 (0.08) | 152 (1.83) | 685 (0.79) |
| M38T/L70Q/E77G/A91G/I118V/T120S/T130A/N152T | 431 | 61 (0.64) | 102 (0.49) | 5 (0.07) | 119 (1.43) | 796 (0.92) |
| R29H/E52G/L70R/E88G/A91G/T130A | 78 | 100 (1.05) | 119 (0.57) | 5 (0.08) | 200 (2.41) | 740 (0.85) |
| Y31H/T41G/M43L/L70Q/A91G/I118V/T120S//I126V/T130A | 432 | 85 (0.89) | 85 (0.41) | 6 (0.08) | 288 (3.47) | 782 (0.90) |
| V68A/T110A | 80 | 103 (1.08) | 233 (1.12) | 48 (0.68) | 163 (1.96) | 861 (0.99) |
| L65H/D90G/T110A/F116L | 433 | 33 (0.35) | 121 (0.58) | 11 (0.15) | 129 (1.55) | 758 (0.88) |
| R29H/E52G/D90N/I118V/T120S/T130A | 434 | 66 (0.69) | 141 (0.68) | 11 (0.15) | 124 (1.49) | 800 (0.92) |
| A91G/L102S | 83 | 6 (0.06) | 6 (0.03) | 5 (0.08) | 75 (0.90) | 698 (0.81) |
| I67T/L70Q/A91G/I118V/T120S | 436 | 98 (1.03) | 160 (0.77) | 5 (0.08) | 1751 (21.1) | 794 (0.92) |
| L70Q/A91G/T110A/I118V/T120S/T130A | 437 | 8 (0.09) | 14 (0.07) | 5 (0.07) | 77 (0.93) | 656 (0.76) |
| M38V/T41D/M43I/W50G/D76G/V83A/K89E/I118V/T120S/I126V/T130A | 438 | 5 (0.06) | 8 (0.04) | 8 (0.11) | 82 (0.99) | 671 (0.78) |
| V22A/L70Q/S121P | 87 | 5 (0.06) | 7 (0.04) | 5 (0.07) | 105 (1.27) | 976 (1.13) |
| A12V/S15F/Y31H/M38L/T41G/M43L/D90N/T130A/P137L/N149D/N152T | 439 | 6 (0.06) | 6 (0.03) | 5 (0.08) | 104 (1.25) | 711 (0.82) |
| I67F/L70R/E88G/A91G/I118V/T120S/T130A | 440 | 5 (0.05) | 6 (0.03) | 6 (0.08) | 62 (0.74) | 1003 (1.16) |
| E24G/L25P/L70Q/A91G/I118V/T120S/N152T | 441 | 26 (0.27) | 38 (0.18) | 8 (0.11) | 101 (1.21) | 969 (1.12) |
| A91G/F92L/F108L/I118V/T120S | 442 | 50 (0.53) | 128 (0.61) | 16 (0.11) | 59 (0.71) | 665 (0.77) |
| WT CD80 | 28 | 95 (1.00) | 208 (1.00) | 70 (1.00) | 83 (1.00) | 866 (1.00) |

TABLE 8

Variant CD80 selected against PD-L1. Molecule sequences, binding data, and costimulatory bioactivity data.

| CD80 mutation(s) | SEQ ID NO (ECD) | Binding: CD28 MFI (parental ratio) | Binding: CTLA-4 MFI (parental ratio) | Binding: PD-L1 MFI (parental ratio) | Coimmobilization with anti-CD3 IFN-gamma pg/ml (parental ratio) | MLR IFN-gamma levels pg/ml (parental ratio) |
|---|---|---|---|---|---|---|
| R29D/Y31L/Q33H/K36G/M38I/T41A/M43R/M47T/E81V/L85R/K89N/A91T/F92P/K93V/R94L/I118T/N149S | 92 | 1071 (0.08) | 1089 (0.02) | 37245 (2.09) | 387 (0.76) | 5028 (0.26) |
| R29D/Y31L/Q33H/K36G/M38I/T41A/M43R/M47T/E81V/L85R/K89N/A91T/F92P/K93V/R94L/N144S/N149S | 93 | 1065 (0.08) | 956 (0.02) | 30713 (1.72) | 400 (0.79) | 7943 (0.41) |
| R29D/Y31L/Q33H/K36G/M38I/T41A/M42T/M43R/M47T/E81V/L85R/K89N/A91T/F92P/K93V/R94L/L148S/N149S | 94 | 926 (0.07) | 954 (0.02) | 47072 (2.64) | 464 (0.91) | 17387 (0.91) |
| E24G/R29D/Y31L/Q33H/K36G/M38I/T41A/M43R/M47T/F59L/E81V/L85R/K89N/A91T/F92P/K93V/R94L/H96R/N149S/C182S | 95 | 1074 (0.08) | 1022 (0.02) | 1121 (0.06) | 406 (0.80) | 13146 (0.69) |
| R29D/Y31L/Q33H/K36G/M38I/T41A/M43R/M47T/E81V/L85R/K89N/A91T/F92P/K93V/R94L/N149S | 96 | 1018 (0.08) | 974 (0.02) | 25434 (1.43) | 405 (0.80) | 24029 (1.25) |
| R29V/M43Q/E81R/L85I/K89R/D90L/A91E/F92N/K93Q/R94G | 97 | 1029 (0.08) | 996 (0.02) | 1575 (0.09) | 342 (0.67) | 11695 (0.61) |
| T41I/A91G | 98 | 17890 (1.35) | 50624 (1.01) | 12562 (0.70) | 433 (0.85) | 26052 (1.36) |
| E88D/K89R/D90K/A91G/F92Y/K93R/N122S/N177S | 443 | 41687 (3.15) | 49429 (0.99) | 20140 (1.13) | 773 (1.52) | 6345 (0.33) |
| E88D/K89R/D90K/A91G/F92Y/K93R | 102 | 51663 (3.91) | 72214 (1.44) | 26405 (1.48) | 1125 (2.21) | 9356 (0.49) |
| K36G/K37Q/M38I/L40M/F59L/E81V/L85R/K89N/A91T/F92P/K93V/R94L/E99G/T130A/N149S | 445 | 1298 (0.10) | 1271 (0.03) | 3126 (0.18) | 507 (1.00) | 3095 (0.16) |
| E88D/K89R/D90K/A91G/F92Y/K93R | 102 | 31535 (2.38) | 50868 (1.02) | 29077 (1.63) | 944 (1.85) | 5922 (0.31) |
| K36G/K37Q/M38I/L40M | 103 | 1170 (0.09) | 1405 (0.03) | 959 (0.05) | 427 (0.84) | 811 (0.04) |
| K36G/L40M | 443 | 29766 (2.25) | 58889 (1.18) | 20143 (1.13) | 699 (1.37) | 30558 (1.59) |
| WTCD80 | 28 | 13224 (1.00) | 50101 (1.00) | 17846 (1.00) | 509 (1.00) | 19211 (1.00) |

Example 7

Ligand Binding Competition Assay

As shown in Example 6, several variant CD80 molecules exhibited improved binding to one or both of CD28 and PD-L1. To further assess the binding activity of CD80 to ligands CD28 and PD-L1, this Example describes a ligand competition assay assessing the non-competitive nature of exemplary variant CD80 polypeptides to bind both CD28 and PD-L1.

An ELISA based binding assay was set up incorporating plate-bound variant CD80 A91G ECD-Fc to assess the ability of CD80 to simultaneously bind CD28 and PD-L1. Maxisorp 96 well ELISA plates (Nunc, USA) were coated overnight with 100 nM human recombinant variant CD80 A91G ECD-Fc fusion protein in PBS. The following day unbound protein was washed out, and the plate was blocked with 1% bovine serum albumin (Millipore, USA)/PBS for 1 hour at room temperature. This blocking reagent was washed out three times with PBS/0.05% Tween, which included a two minute incubation on a platform shaker for each wash.

In one arm of the competition assay, CD80 was incubated with CD28, and then CD28-bound CD80 was then assessed for competitive binding in the presence of either the other known CD80 ligand counter structures PD-L1 or CTLA-4 or negative control ligand PD-L2. Specifically, biotinylated recombinant human CD28 Fc fusion protein (rCD28.Fc; R&D Systems) was titrated into the wells starting at 10 nM, diluting out for eight points with 1:2 dilutions in a 25 μl volume. Immediately after adding the biotinylated rCD28.Fc, unlabeled competitive binders, recombinant human PD-L1 monomeric his-tagged protein, recombinant human CTLA-4 monomeric his-tagged protein, or a negative control human recombinant PD-L2 Fc fusion protein (R&D Systems) were added to wells at 2000/1000/500 nM, respectively, in a 25 μl volume for a final volume of 50 μl. These proteins were incubated together for one hour before repeating the three wash steps as described above.

After washing, 2.5 ng per well of HRP-conjugated streptavidin (Jackson Immunoresearch, USA) were diluted in 1% BSA/PBS and added to wells to detect bound biotinylated rCD28.Fc. After a one hour incubation, wells were washed again three times as described above. To detect signal, 50 μl of TMB substrate (Pierce, USA) were added to the wells following the wash and incubated for 7 minutes, before adding 50 ul 2M sulfuric acid stop solution. Optical density was determined on an Emax Plus microplate reader (Molecular Devices, USA). Optical density values were graphed in Prism (Graphpad, USA).

Figure 7A:
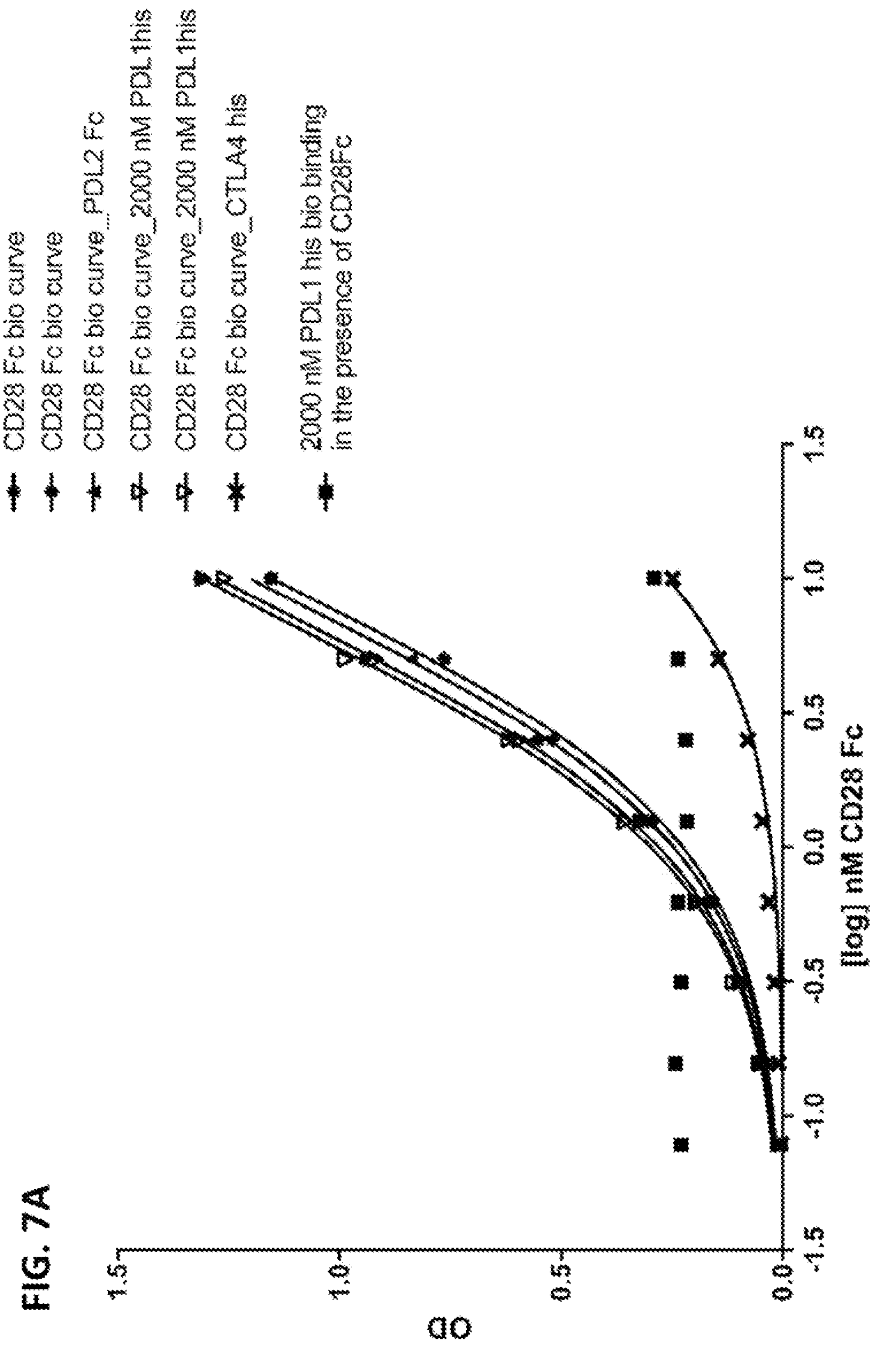
FIG. 7A depicts results of a competition binding assay for binding of biotinylated recombinant CD28 Fc fusion protein (rCD28.Fc) to immobilized variant CD80 A91G ECD-Fc fusion molecule in the presence of unlabeled recombinant human PD-L1-his, human CTLA-4-his or human-PD-L2-Fc fusion protein.

The results are set forth in FIG. 7A. The results showed decreased binding of biotinylated rCD28.Fc to the variant CD80 A91G ECD-Fc fusion protein with titration of the rCD28.Fc. When rCD28.Fc binding was performed in the presence of non-competitive control protein, rPDL2, there was no decrease in CD28 binding for CD80 (solid triangle). In contrast, a competitive control protein, rCTLA-4, when incubated with the CD28.Fc, did result in decreased CD28 binding for CD80 as expected (x line). When recombinant PD-L1 was incubated with CD28.Fc, no decrease in CD28 binding to CD80 was observed, which demonstrated that the epitopes of CD28 and PD-L1 for CD80 are non-competitive. Binding of the recombinant PD-L1 protein used in the CD28 competition assay to CD80 was confirmed by incubating the biotinylated PD-L1 in the presence of non-biotinylated rCD28.Fc (square).

The reverse competition also was set up in which CD80 was incubated with PD-L1, and then PD-L-bound CD80 was then assessed for competitive binding in the presence of either the other known CD80 ligand counter structures CD28 or CTLA-4 or negative control ligand PD-L2. Specifically, the assay was performed by titrating biotinylated recombinant human PD-L1-His monomeric protein into wells containing the recombinant variant CD80. Because binding is weaker with this ligand, titrations started at 5000 nM with similar 1:2 dilutions over eight points in 25 μL. When the rPD-L1-his was used to detect binding, the competitive ligands human rCD28.Fc, human rCTLA-4.Fc, or human rPD-L2.Fc control were added at 2.5 nM final concentration in 25 μl for a total volume of 50 μl. The subsequent washes, detection, and OD measurements were the same as described above.

Figure 7B:
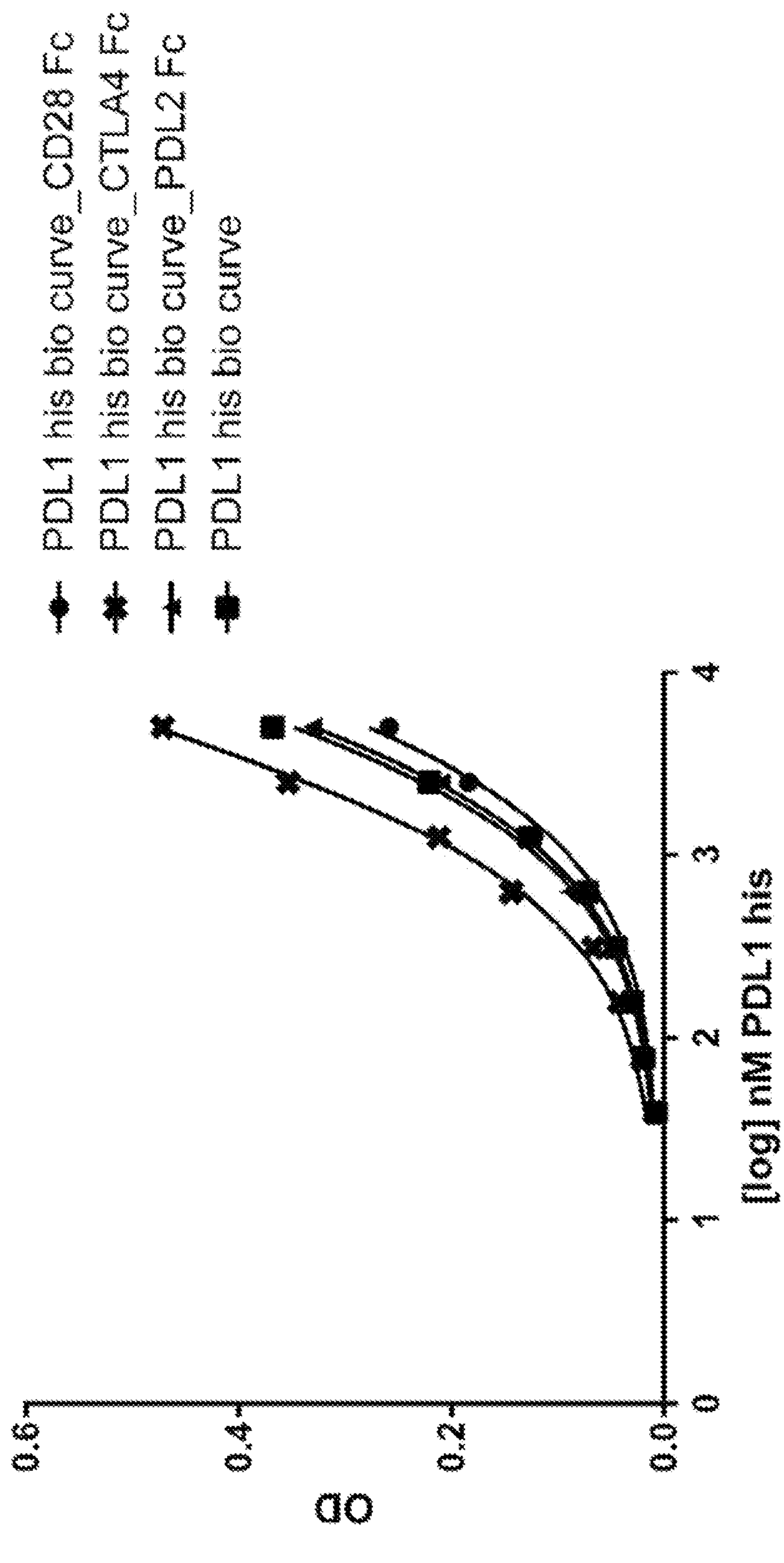
FIG. 7B depicts results of a competition binding assay for binding of biotinylated recombinant human PD-L1-his monomeric protein to immobilized variant CD80 A91G ECD-Fc fusion molecule in the presence of unlabeled recombinant human rCD28.Fc, human CTLA-4.Fc or human PD-L2.Fc.

The results are set forth in FIG. 7B. Titrated PD-L1-his binding alone confirmed that PD-L1 bound to the variant CD80 A91G ECD-Fc fusion molecule immobilized on the plate (square). When PD-L1-His binding was performed in the presence of non-competitive control protein, rPDL2, there was no decrease in PD-L1 binding for CD80 (triangle). The CD28-competitive control protein, rCTLA-4, when incubated with the PD-L1-his, did not result in decreased PD-L1 binding for CD80 (x line), even though CTLA-4 is competitive for CD28. This result further demonstrated that lack of competition between CD28 and PD-L1 for CD80 binding. Finally, when PD-L1-his was incubated with CD28.Fc, no decrease in PD-L1 binding to CD80 was observed, which demonstrated that the epitopes of CD28 and PD-L1 for CD80 are non-competitive.

Thus, the results showed that CTLA-4, but not PD-L1 or the negative control PD-L2, competed for binding of CD28 to CD80 (FIG. 7A) and that CD28, CTLA-4, and PD-L2 did not compete for binding of PD-L1 to CD80 (FIG. 7B). Thus, these results demonstrated that CD28 and PD-L1 are non-competitive binders of CD80, and that this non-competitive binding can be demonstrated independently of which ligand is being detected in the ELISA.

Example 8

Additional Affinity Modified IgSF Domains

This example describes the design, creation, and screening of additional affinity modified ICOSL, CD86 (B7-2) and NKp30 immunomodulatory proteins, which are other components of the immune synapse (IS) that have a demonstrated dual role in both immune activation and inhibition. These examples demonstrate that affinity modification of IgSF domains yields proteins that can act to both increase and decrease immunological activity. This work also describes the various combinations of those domains fused in pairs (i.e., stacked) with a variant affinity modified CD80 to form a Type II immunomodulatory protein to achieve immunomodulatory activity.

Mutant DNA constructs of human ICOSL, CD86 and NKp30 IgSF domains for translation and expression as yeast display libraries were generated substantially as described in Example 1. For libraries that target specific residues of target protein for complete or partial randomization with degenerate codons, the coding DNA sequences for the extracellular domains (ECD) of human ICOSL (SEQ ID NO:32) and NKp30 (SEQ ID NO:54) were ordered from Integrated DNA Technologies (Coralville, Iowa) as a set of overlapping oligonucleotides of up to 80 base pairs (bp) in length. Residues were mutated by targeted mutagenesis substantially as described in Example 1. Alternatively, random libraries were constructed to identify variants of the ECD of ICOSL (SEQ ID NO:32), CD86 (SEQ ID NO: 29) and NKp30 (SEQ ID NO:54) substantially as described in Example 1.

The degenerate and random library DNA was introduced into yeast substantially as described in Example 2 to generate yeast libraries. The libraries were used to select yeast expressing affinity modified variants of ICOSL, CD86 and NKp30 substantially as described in Example 3. Cells were processed to reduce non-binders and to enrich for ICOSL, CD86 or NKp30 variants with the ability to bind their exogenous recombinant counter-structure proteins substantially as described in Example 3. This was then followed by two to three rounds of flow cytometry sorting using exogenous counter-structure protein staining to enrich the fraction of yeast cells that displays improved binders. Magnetic bead enrichment and selections by flow cytometry are essentially as described in Keith D. Miller, 1 Noah B. Pefaur, 2 and Cheryl L. Bairdl Current Protocols in Cytometry 4.7.1-4.7.30, July 2008.

With ICOSL, CD86 and NKp30 libraries, target ligand proteins were sourced from R&D Systems (USA) as follows: human rCD28.Fc (i.e., recombinant CD28-Fc fusion protein), rCTLA4.Fc, rICOS.Fc, and rB7H6.Fc. Two-color flow cytometry was performed substantially as described in Example 3. Yeast outputs from the flow cytometric sorts were assayed for higher specific binding affinity. Sort output yeast were expanded and re-induced to express the particular IgSF affinity modified domain variants they encode. This population then can be compared to the parental, wild-type yeast strain, or any other selected outputs, such as the bead output yeast population, by flow cytometry.

For ICOSL, the second sort outputs (F2) were compared to parental ICOSL yeast for binding of each rICOS.Fc, rCD28.Fc, and rCTLA4.Fc by double staining each population with anti-HA (hemagglutinin) tag expression and the anti-human Fc secondary to detect ligand binding.

In the case of ICOSL yeast variants selected for binding to ICOS, the F2 sort outputs gave Mean Fluorescence Intensity (MFI) values of 997, when stained with 5.6 nM rICOS.Fc, whereas the parental ICOSL strain MFI was measured at 397 when stained with the same concentration of rICOS.Fc. This represents a roughly three-fold improvement of the average binding in this F2 selected pool of clones, and it is predicted that individual clones from that pool will have much better improved MFI/affinity when individually tested.

In the case of ICOSL yeast variants selected for binding to CD28, the F2 sort outputs gave MFI values of 640 when stained with 100 nM rCD28.Fc, whereas the parental ICOSL strain MFI was measured at 29 when stained with the same concentration of rCD28.Fc (22-fold improvement). In the case of ICOSL yeast variants selected for binding to CTLA-4, the F2 sort outputs gave MFI values of 949 when stained with 100 nM rCTLA4.Fc, whereas the parental ICOSL strain MFI was measured at 29 when stained with the same concentration of rCTLA4.Fc (32-fold improvement).

In the case of NKp30 yeast variants selected for binding to B7-H6, the F2 sort outputs gave MFI values of 533 when stained with 16.6 nM rB7H6.Fc, whereas the parental NKp30 strain MFI was measured at 90 when stained with the same concentration of rB7H6.Fc (6-fold improvement).

Among the NKp30 variants that were identified, was a variant that contained mutations L30V/A60V/S64P/S86G with reference to positions in the NKp30 extracellular domain corresponding to positions set forth in SEQ ID NO:54. Among the CD86 variants that were identified, was a variant that contained mutations Q35H/H90L/Q102H with reference to positions in the CD86 extracellular domain corresponding to positions set forth in SEQ ID NO:29. Among the ICOSL variants that were identified, were variants set forth in Table 9 and described further below.

As with CD80, the MFIs of all F2 outputs described above when measured with the anti-HA antibody on FL1 did not increase and sometimes went down compared to wild-type strains, indicating that increased binding was not a function of increased expression of the selected variants on the surface of yeast, and validated gating strategies of only selecting mid to low expressors with high ligand binding.

Exemplary selection outputs were reformatted as immunomodulatory proteins containing an affinity modified (variant) extracellular domain (ECD) of ICOSL fused to an Fc molecule (variant ECD-Fc fusion molecules) substantially as described in Example 4 and the Fc-fusion protein was expressed and purified substantially as described in Example 5.

Binding of exemplary ICOSL Fc-fusion variants to cell-expressed counter structures was then assessed substantially as described in Example 6. To produce cells expressing cognate binding partners, full-length mammalian surface expression constructs for each of human CD28, and ICOS were produced substantially as described in Example 6. Binding studies and flow cytometry were carried out substantially as described in Example 6. In addition, the bioactivity of the Fc-fusion variant protein was characterized by either mixed lymphocyte reaction (MLR) or anti-CD3 coimmobilization assay substantially as described in Example 6.

Results for the binding and activity studies for exemplary tested variants are shown in Table 9. In particular, Table 9 indicates exemplary IgSF domain amino acid substitutions (replacements) in the ECD of ICOSL selected in the screen for affinity-maturation against the respective cognate structures ICOS and CD28. The exemplary amino acid substitutions are designated by amino acid position number corresponding to the respective reference unmodified ECD sequence as follows. For example, the reference unmodified ECD sequence in Table 9 is the unmodified ICOSL ECD sequence set forth in SEQ ID NO:32. The amino acid position is indicated in the middle, with the corresponding unmodified (e.g. wild-type) amino acid listed before the number and the identified variant amino acid substitution listed after the number. Column 2 sets forth the SEQ ID NO identifier for the variant ECD for each variant ECD-Fc fusion molecule.

Also shown is the binding activity as measured by the Mean Fluorescence Intensity (MFI) value for binding of each variant Fc-fusion molecule to cells engineered to express the cognate counter structure ligand and the ratio of the MFI compared to the binding of the corresponding unmodified ECD-Fc fusion molecule not containing the amino acid substitution(s) to the same cell-expressed counter structure ligand. The functional activity of the variant Fc-fusion molecules to modulate the activity of T cells also is shown based on the calculated levels of IFN-gamma in culture supernatants (pg/ml) generated either i) with the indicated variant ECD-Fc fusion molecule coimmoblized with anti-CD3 or ii) with the indicated variant ECD-Fc fusion molecule in an MLR assay. The Tables also depict the ratio of IFN-gamma produced by each variant ECD-Fc compared to the corresponding unmodified ECD-Fc in both functional assays.

As shown, the selections resulted in the identification of a number of ICOSL IgSF domain variants that were affinity-modified to exhibit increased binding for at least one, and in some cases more than one, cognate counter structure ligand. In addition, the results showed that affinity modification of the variant molecules also exhibited improved activities to both increase and decrease immunological activity depending on the format of the molecule. For example, coimmobilization of the ligand likely provides a multivalent interaction with the cell to cluster or increase the avidity to favor agonist activity and increase T cell activation compared to the unmodified (e.g. wildtype) ECD-Fc molecule not containing the amino acid replacement(s). However, when the molecule is provided as a bivalent Fc molecule in solution, the same IgSF domain variants exhibited an antagonist activity to decrease T cell activation compared to the unmodified (e.g. wildtype) ECD-Fv molecule not containing the amino acid replacement(s).

TABLE 9

ICOSL variants selected against CD28 or ICOS. Molecule sequences, binding data, and costimulatory bioactivity data.

| | | Binding | | Coimmobilization with anti-CD3 IFN-gamma | MLR IFN-gamma |
|---|---|---|---|---|---|
| ICOSL mutation(s) | SEQ ID NO (ECD) | ICOS OD (parental ratio) | CD28 MFI (parental ratio) | pg/ml (parental ratio) | levels pg/ml (parental ratio) |
| N52S | 109 | 1.33 (1.55) | 162 (9.00) | 1334 (1.93) | 300 (0.44) |
| N52H | 110 | 1.30 (1.51) | 368 (20.44) | 1268 (1.83) | 39 (0.06) |
| N52D | 111 | 1.59 (1.85) | 130 (7.22) | 1943 (2.80) | 190 (0.28) |
| N52Y/N57Y/F138L/L203P | 112 | 1.02 (1.19) | 398 (22.11) | 510* (1.47*) | 18 (0.03) |
| N52H/N57Y/Q100P | 113 | 1.57 (1.83) | 447 (24.83) | 2199 (3.18) | 25 (0.04) |
| N52S/Y146C/Y152C | 114 | 1.26 (1.47) | 39 (2.17) | 1647 (2.38) | 152 (0.22) |
| N52H/C198R | 115 | 1.16 (1.35) | 363 (20.17) | 744* (2.15*) | ND (ND) |
| N52H/C140del/T225A | 478 | ND (ND) | 154 (8.56) | 522* (1.51*) | ND (ND) |
| N52H/C198R/T225A | 117 | 1.41 (1.64) | 344 (19.11) | 778* (2.25*) | 0 (0) |
| N52H/K92R | 118 | 1.48 (1.72) | 347 (19.28) | 288* (0.83*) | 89 (0.13) |
| N52H/S99G | 119 | 0.09 (0.10) | 29 (1.61) | 184* (0.53*) | 421 (0.61) |
| N52Y | 120 | 0.08 (0.09) | 18 (1.00) | 184* (0.53*) | 568 (0.83) |
| N57Y | 121 | 1.40 (1.63) | 101 (5.61) | 580* (1.68*) | 176 (0.26) |
| N57Y/Q100P | 122 | 0.62 (0.72) | 285 (15.83) | 301* (0.87*) | 177 (0.26) |
| N52S/S130G/Y152C | 123 | 0.16 (0.19) | 24 (1.33) | 266* (0.77*) | 1617 (2.35) |
| N52S/Y152C | 124 | 0.18 (0.21) | 29 (1.61) | 238* (0.69*) | 363 (0.53) |
| N52S/C198R | 125 | 1.80 (2.09) | 82 (4.56) | 1427 (2.06) | 201 (0.29) |
| N52Y/N57Y/Y152C | 126 | 0.08 (0.09) | 56 (3.11) | 377* (1.09*) | 439 (0.64) |
| N52Y/N57Y/H129P/C198R | 127 | ND (ND) | 449 (24.94) | 1192 (1.72) | ND (ND) |
| N52H/L161P/C198R | 128 | 0.18 (0.21) | 343 (19.05) | 643* (1.86*) | 447 (0.65) |
| N52S/T113E | 129 | 1.51 (1.76) | 54 (3.00) | 451* (1.30*) | 345 (0.50) |
| S54A | 130 | 1.62 (1.88) | 48 (2.67) | 386* (1.12*) | 771 (1.12) |
| N52D/S54P | 131 | 1.50 (1.74) | 38 (2.11) | 476* (1.38*) | 227 (0.33) |
| N52K/L208P | 132 | 1.91 (2.22) | 291 (16.17) | 1509 (2.18) | 137 (0.20) |
| N52S/Y152H | 133 | 0.85 (0.99) | 68 (3.78) | 2158 (3.12) | 221 (0.32) |
| N52D/V151A | 134 | 0.90 (1.05) | 19 (1.06) | 341* (0.99*) | 450 (0.66) |
| N52H/I143T | 135 | 1.83 (2.13) | 350 (19.44) | 2216 (3.20) | 112 (0.16) |
| N52S/L80P | 136 | 0.09 (0.10) | 22 (1.22) | 192* (0.55*) | 340 (0.49) |
| F120S/Y152H/N201S | 137 | 0.63 (0.73) | 16 (0.89) | 351* (1.01*) | 712 (1.04) |
| N52S/R75Q/L203P | 138 | 1.71 (1.99) | 12 (0.67) | 1996 (2.88) | 136 (0.20) |
| N52S/D158G | 139 | 1.33 (1.55) | 39 (2.17) | 325* (0.94*) | 277 (0.40) |
| N52D/Q133H | 140 | 1.53 (1.78) | 104 (5.78) | 365* (1.05*) | 178 (0.26) |
| WT ICOSL | 32 | 0.86 (1.00) | 18 (1.00) | 692/346* (1.00) | 687 (1.00) |

*Parental ratio calculated using 346 pg/ml IFN-gamma for WT ICOSL

Example 9

Generation and Assessment of Stacked Molecules Containing Different Affinity-Modified Domains This Example describes further immunomodulatory proteins that were generated as stack constructs containing at least two different affinity modified domains from identified variant CD80 polypeptides and one more additional variant CD80, CD86, ICOSL, and NKp30 molecules linked together and fused to an Fc.

Selected variant molecules described above that were affinity-modified for one or more counter structure ligand were used to generate "stack" molecule (i.e., Type II immunomodulatory protein) containing two or more affinity-modified IgSF domains. Stack constructs were obtained as geneblocks (Integrated DNA Technologies, Coralville, Iowa) that encode the stack in a format that enables its fusion to Fc by standard Gibson assembly using a Gibson assembly kit (New England Biolabs).

The encoding nucleic acid molecule of all stacks was generated to encode a protein designed as follows: Signal peptide, followed by the first variant IgV of interest, followed by a 15 amino acid linker which is composed of three GGGGS(G4S) motifs (SEQ ID NO:228), followed by the second IgV of interest, followed by two GGGGS linkers (SEQ ID NO: 229) followed by three alanines (AAA), followed by a human IgG1 Fc as described above. To maximize the chance for correct folding of the IgV domains in each stack, the first IgV was preceded by all residues that normally occur in the wild-type protein between this IgV and the signal peptide (leading sequence). Similarly, the first IgV was followed by all residues that normally connect it in the wild-type protein to either the next Ig domain (typically an IgC domain) or if such a second IgV domain is absent, the residues that connect it to the transmembrane domain (trailing sequence). The same design principle was applied to the second IgV domain except that when both IgV domains were derived from same parental protein (e.g. a CD80 IgV stacked with another CD80 IgV), the linker between both was not duplicated.

Table 10 sets forth the design for exemplary stacked constructs. The exemplary stack molecules shown in Table 10 contain the IgV domains as indicated and additionally leading or trailing sequences as described above. In the Table, the following components are present in order: signal peptide (SP; SEQ ID NO:225), IgV domain 1 (IgV1), trailing sequence 1 (TS1), linker 1 (LR1; SEQ ID NO:228), IgV domain 2 (IgV2), trailing sequence 2 (TS2), linker 2 (LR2; SEQ ID NO:230) and Fc domain (SEQ ID NO:226 containing C5S/R77C/N82G/V87C amino acid substitutions). In some cases, a leading sequence 1 (LS1) is present between the signal peptide and IgV1 and in some cases a leading sequence 2 (LS2) is present between the linker and IgV2.

TABLE 10

Amino acid sequence (SEQ ID NO) of components of exemplary stacked constructs

| | | First domain | | | | Second domain | | | | |
|---|---|---|---|---|---|---|---|---|---|---|
| | SP | LS1 | IgV1 | TS1 | LR1 | LS2 | IgV2 | TS2 | LR2 | Fc |
| Domain 1: NKp30 WT<br>Domain 2: CD80 WT | + | − | 214 | 235 | + | − | 152 | 371 | + | + |
| Domain 1: NKp30 WT<br>Domain 2: CD86 WT | + | − | 214 | 235 | + | 236 | 220 | 237 | + | + |
| Domain 1: NKp30 L30V/A60V/S64P/S86G<br>Domain 2: CD80 R29H/Y31H/T41G/Y87N/E88G/K89E/D90N/A91G/P109S | + | − | 215 | 235 | + | − | 192 | 371 | + | + |
| Domain 1: NKp30 L30V/A60V/S64P/S86G<br>Domain 2: CD80 I67T/L70Q/A91G/T120S | + | − | 215 | 235 | + | − | 175 | 371 | + | + |
| Domain 1: CD80 WT<br>Domain 2: Nkp30 WT | + | − | 152 | 371 | + | − | 214 | 235 | + | + |
| Domain 1: CD80 R29H/Y31H/T41G/Y87N/E88G/K89E/D90N/A91G/P109S<br>Domain 2: NKp30 L30V/A60V/S64P/S86G | + | − | 192 | 371 | + | − | 215 | 235 | + | + |
| Domain 1: CD80 I67T/L70Q/A91G/T120S<br>Domain 2: NKp30 L30V/A60V/S64P/S86G | + | − | 175 | 371 | + | − | 215 | 235 | + | + |

TABLE 10-continued

Amino acid sequence (SEQ ID NO) of components of exemplary stacked constructs

| | | First domain | | | | Second domain | | | | |
|---|---|---|---|---|---|---|---|---|---|---|
| | SP | LS1 | IgV1 | TS1 | LR1 | LS2 | IgV2 | TS2 | LR2 | Fc |
| Domain 1: CD80 WT<br>Domain 2: ICOSL WT | + | − | 152 | 371 | + | − | 196 | 233 | + | + |
| Domain 1: CD80 WT<br>Domain 2: CD86 WT | + | − | 152 | 371 | + | 236 | 220 | 237 | + | + |
| Domain 1: CD80 WT<br>Domain 2: CD80 WT | + | − | 152 | 371 | + | − | 152 | 371 | + | + |
| Domain 1: CD80 E88D/K89R/D90K/A91G/F92Y/K93R<br>Domain 2: CD80 R29H/Y31H/T41G/Y87N/E88G/K89E/D90N/A91G/P109S | + | − | 189 | 371 | + | − | 192 | 371 | + | + |
| Domain 1: CD80 A12T/H18L/M43V/F59L/E77K/P109S/I118T<br>Domain 2: CD80 R29H/Y31H/T41G/Y87N/E88G/K89E/D90N/A91G/P109S | + | − | 193 | 371 | + | − | 192 | 371 | + | + |
| Domain 1: CD80 A12T/H18L/M43V/F59L/E77K/P109S/I118T<br>Domain 2: CD80 I67T/L70Q/A91G/T120S | + | − | 193 | 371 | + | − | 175 | 371 | + | + |
| Domain 1: CD80 E88D/K89R/D90K/A91G/F92Y/K93R<br>Domain 2: CD86 Q35H/H90L/Q102H | + | − | 189 | 371 | + | 236 | 221 | 237 | + | + |
| Domain 1: CD80 A12T/H18L/M43V/F59L/E77K/P109S/I118T<br>Domain 2: CD86 Q35H/H90L/Q102H | + | − | 193 | 371 | + | 236 | 221 | 237 | + | + |
| Domain 1: CD80 E88D/K89R/D90K/A91G/F92Y/K93R<br>Domain 2: ICOSL N525/N57Y/H94D/L96F/L98F/Q100R/G103E/F120S | + | − | 189 | 371 | + | − | 213 | 233 | + | + |
| Domain 1: CD80 A12T/H18L/M43V/F59L/E77K/P109S/I118T<br>Domain 2: ICOSL N525/N57Y/H94D/L96F/L98F/Q100R/G103E/F120S | + | − | 193 | 371 | + | − | 213 | 233 | + | + |
| Domain 1: CD80 A12T/H18L/M43V/F59L/E77K/P109S/I118T<br>Domain 2: ICOSL N52D | + | − | 193 | 371 | + | − | 199 | 233 | + | + |
| Domain 1: CD80 E88D/K89R/D90K/A91G/F92Y/K93R<br>Domain 2: ICOSL N52H/N57Y/Q100P | + | − | 189 | 371 | + | − | 201 | 233 | + | + |

TABLE 10-continued

Amino acid sequence (SEQ ID NO) of components of exemplary stacked constructs

| | SP | LS1 | IgV1 (First domain) | TS1 (First domain) | LR1 | LS2 | IgV2 (Second domain) | TS2 (Second domain) | LR2 | Fc |
|---|---|---|---|---|---|---|---|---|---|---|
| Domain 1: CD80 A12T/H18L/M43V/F59L/E77K/P109S/I118T Domain 2: ICOSL N52H/N57Y/Q100P | + | − | 193 | 371 | + | − | 201 | 233 | + | + |
| Domain 1: ICOSL WT Domain 2: CD80 WT | + | − | 196 | 233 | + | − | 152 | 371 | + | + |
| Domain 1: CD86 WT Domain 2: CD80 WT | + | 236 | 220 | 237 | + | − | 152 | 371 | + | + |
| Domain 1: CD80 R29H/Y31H/T41G/Y87N/E88G/K89E/D90N/A91G/P109S Domain 2: CD80 E88D/K89R/D90K/A91G/F92Y/K93R | + | − | 192 | 371 | + | − | 189 | 371 | + | + |
| Domain 1: CD80 R29H/Y31H/T41G/Y87N/E88G/K89E/D90N/A91G/P109S Domain 2: CD80 A12T/H18L/M43V/F59L/E77K/P109S/I118T | + | − | 192 | 371 | + | − | 193 | 371 | + | + |
| Domain 1: CD80 I67T/L70Q/A91G/T120S Domain 2: CD80 E88D/K89R/D90K/A91G/F92Y/K93R | + | − | 175 | 371 | + | − | 189 | 371 | + | + |
| Domain 1: CD80 I67T/L70Q/A91G/T120S Domain 2: CD80 A12T/H18L/M43V/F59L/E77K/P109S/I118T | + | − | 175 | 371 | + | − | 193 | 371 | + | + |
| Domain 1: CD86 Q35H/H90L/Q102H Domain 2: CD80 E88D/K89R/D90K/A91G/F92Y/K93R | + | 236 | 221 | 237 | + | − | 189 | 371 | + | + |
| Domain 1: CD86 Q35H/H90L/Q102H Domain 2: CD80 A12T/H18L/M43V/F59L/E77K/P109S/I118T | + | 236 | 221 | 237 | + | − | 193 | 371 | + | + |
| Domain 1: ICOSL N525/N57Y/H94D/L96F/L98F/Q100R/G103E/F120S Domain 2: CD80 E88D/K89R/D90K/A91G/F92Y/K93R | + | − | 213 | 233 | + | − | 189 | 371 | + | + |
| Domain 1: ICOSL N525/N57Y/H94D/L96F/L98F/Q100R/G103E/F120S Domain 2: CD80 A12T/H18L/M43V/F59L/E77K/P109S/I118T | + | − | 213 | 233 | + | − | 193 | 371 | + | + |
| Domain 1: ICOSL N52D Domain 2: CD80 E88D/K89R/D90K/A91G/F92Y/K93R | + | − | 199 | 233 | + | − | 189 | 371 | + | + |

TABLE 10-continued

Amino acid sequence (SEQ ID NO) of components of exemplary stacked constructs

| | SP | LS1 | IgV1 | TS1 | LR1 | LS2 | IgV2 | TS2 | LR2 | Fc |
|---|---|---|---|---|---|---|---|---|---|---|
| | | | First domain | | | | Second domain | | | |
| Domain 1: ICOSL N52D Domain 2: CD80 A12T/H18L/M43V/ F59L/E77K/P109S/ I118T | + | − | 199 | 233 | + | − | 193 | 371 | + | + |
| Domain 1: ICOSL N52H/N57Y/Q100P Domain 2: CD80 E88D/K89R/D90K/ A91G/F92Y/K93R | + | − | 201 | 233 | + | − | 189 | 371 | + | + |
| Domain 1: ICOSL N52H/N57Y/Q100P Domain 2: CD80 A12T/H18L/M43V/ F59L/E77K/P109S/ I118T | + | − | 201 | 233 | + | − | 193 | 371 | + | + |
| Domain 1: CD80 V68M/L70P/L72P/ K86E Domain 2: CD80 E88D/K89R/D90K/ A91G/F92Y/K93R | + | − | 195 | 371 | + | − | 189 | 371 | + | + |
| Domain 1: CD80 R29V/Y31F/K36G/ M38L/M43Q/E81R/ V83I/L85I/K89R/ D90L/A91E/F92N/ K93Q/R94G Domain 2: CD80 E88D/K89R/D90K/ A91G/F92Y/K93R | + | − | 194 | 371 | + | − | 189 | 371 | + | + |
| Domain 1: CD80 V68M/L70P/L72P/ K86E Domain 2: CD80 A12T/H18L/M43V/ F59L/E77K/P109S/ I118T | + | − | 195 | 371 | + | − | 193 | 371 | + | + |
| Domain 1: CD80 R29V/Y31F/K36G/ M38L/M43Q/E81R/ V83I/L85I/K89R/ D90L/A91E/F92N/ K93Q/R94G Domain 2: CD80 A12T/H18L/M43V/ F59L/E77K/P109S/ I118T | + | − | 194 | 371 | + | − | 193 | 371 | + | + |
| Domain 1: CD80 E88D/K89R/D90K/ A91G/F92Y/K93R Domain 2: CD80 V68M/L70P/L72P/ K86E | + | − | 189 | 371 | + | − | 195 | 371 | + | + |
| Domain 1: CD80 E88D/K89R/D90K/ A91G/F92Y/K93R Domain 2: CD80 R29V/Y31F/K36G/ M38L/M43Q/E81R/ V83I/L85I/K89R/ D90L/A91E/F92N/ K93Q/R94G | + | − | 189 | 371 | + | − | 194 | 371 | + | + |
| Domain 1: CD80 A12T/H18L/M43V/ F59L/E77K/P109S/ I118T Domain 2: CD80 V68M/L70P/L72P/ K86E | + | − | 193 | 371 | + | − | 195 | 371 | + | + |

TABLE 10-continued

Amino acid sequence (SEQ ID NO) of components of exemplary stacked constructs

| | SP | LS1 | IgV1 | TS1 | LR1 | LS2 | IgV2 | TS2 | LR2 | Fc |
|---|---|---|---|---|---|---|---|---|---|---|
| | | First domain | | | | Second domain | | | | |
| Domain 1: CD80 A12T/H18L/M43V/F59L/E77K/P109S/I118T Domain 2: CD80 R29V/Y31F/K36G/M38L/M43Q/E81R/V83I/L85I/K89R/D90L/A91E/F92N/K93Q/R94G | + | − | 193 | 371 | + | − | 194 | 371 | + | + |
| Domain 1: CD80 R29H/Y31H/T41G/Y87N/E88G/K89E/D90N/A91G/P109S Domain 2: ICOSL N52S/N57Y/H94D/L96F/L98F/Q100R/G103E/F120S | + | − | 192 | 371 | + | − | 213 | 233 | + | + |
| Domain 1: CD80 I67T/L70Q/A91G/T120S Domain 2: ICOSL N52S/N57Y/H94D/L96F/L98F/Q100R/G103E/F120S | + | − | 175 | 371 | + | − | 213 | 233 | + | + |
| Domain 1: CD80 R29H/Y31H/T41G/Y87N/E88G/K89E/D90N/A91G/P109S Domain 2: ICOSL N52D | + | − | 192 | 371 | + | − | 199 | 233 | + | + |
| Domain 1: CD80 I67T/L70Q/A91G/T120S Domain 2: ICOSL N52D | + | − | 175 | 371 | + | − | 199 | 233 | + | + |
| Domain 1: CD80 R29H/Y31H/T41G/Y87N/E88G/K89E/D90N/A91G/P109S Domain 2: ICOSL N52H/N57Y/Q100P | + | − | 192 | 371 | + | − | 201 | 233 | + | + |
| Domain 1: CD80 I67T/L70Q/A91G/T120S Domain 2: ICOSL N52H/N57Y/Q100P | + | − | 175 | 371 | + | − | 201 | 233 | + | + |
| Domain 1: ICOSL N52S/N57Y/H94D/L96F/L98F/Q100R/G103E/F120S Domain 2: CD80 R29H/Y31H/T41G/Y87N/E88G/K89E/D90N/A91G/P109S | + | − | 213 | 233 | + | − | 192 | 371 | + | + |
| Domain 1: ICOSL N52S/N57Y/H94D/L96F/L98F/Q100R/G103E/F120S Domain 2: CD80 I67T/L70Q/A91G/T120S | + | − | 213 | 233 | + | − | 175 | 371 | + | + |
| Domain 1: ICOSL N52D Domain 2: CD80 R29H/Y31H/T41G/Y87N/E88G/K89E/D90N/A91G/P109S | + | − | 199 | 233 | + | − | 192 | 371 | + | + |
| Domain 1: ICOSL N52D Domain 2: CD80 I67T/L70Q/A91G/T120S | + | − | 199 | 233 | + | − | 175 | 371 | + | + |

TABLE 10-continued

| Amino acid sequence (SEQ ID NO) of components of exemplary stacked constructs | | | | | | | | | | |
|---|---|---|---|---|---|---|---|---|---|---|
| | First domain | | | | | Second domain | | | | |
| | SP | LS1 | IgV1 | TS1 | LR1 | LS2 | IgV2 | TS2 | LR2 | Fc |
| Domain 1: ICOSL N52H/N57Y/Q100P Domain 2: CD80 R29H/Y31H/T41G/ Y87N/E88G/K89E/ D90N/A91G/P109S | + | − | 201 | 233 | + | − | 192 | 371 | + | + |

High throughput expression and purification of the variant IgV-stacked-Fc fusion molecules containing various combinations of variant IgV domains from CD80, CD86, ICOSL or Nkp30 containing at least one affinity-modified IgV domain were generated substantially as described in Example 5. Binding of the variant IgV-stacked-Fc fusion molecules to respective counter structures and functional activity by anti-CD3 coimmobilization assay also were assessed substantially as described in Example 6. For example, costimulatory bioactivy of the stacked IgSF Fc fusion proteins was determined in a similar immobilized anti-CD3 assay as above. In this case, 4 nM of anti-CD3 (OKT3, Biolegend, USA) was coimmobilized with 4 nM to 120 nM of human rB7-H6.Fc (R&D Systems, USA) or human rPD-L1.Fc (R&D Systems, USA) overnight on tissue-culture treated 96-well plates (Corning, USA). The following day unbound protein was washed off with PBS and 100,000 purified pan T cells were added to each well in 100 ul Ex-Vivo 15 media (Lonza, Switzerland). The stacked IgSF domains were subsequently added at concentrations ranging from 8 nM to 40 nM in a volume of 100 µl for 200 µl volume total. Cells were cultured 3 days before harvesting culture supernatants and measuring human IFN-gamma levels with Duoset ELISA kit (R&D Systems, USA) as mentioned above.

The results are set forth in Tables 11-14. Table 11 sets forth binding and functional activity results for variant IgV-stacked-Fc fusion molecules containing an Nkp30 IgV domain and a CD80 or CD86 IgV domain. Table 12 sets forth binding and functional activity results for variant IgV-stacked-Fc fusion molecules containing a variant CD80 IgV domain and a CD80, CD86 or ICOSL IgV domain. Table 13 sets forth binding and functional activity results for variant IgV-stacked-Fc fusion molecules containing two variant CD80 IgV domains. Table 14 sets forth results for variant IgV-stacked Fc fusion molecules containing a variant CD80 IgV domain and a variant ICOSL IgV domain.

For each of Tables 11-14, Column 1 indicates the structural organization and orientation of the stacked, affinity modified or wild-type (WT) domains beginning with the amino terminal (N terminal) domain, followed by the middle WT or affinity modified domain located before the C terminal human IgG1 Fc domains. Column 2 sets forth the SEQ ID NO identifier for the sequence of each IgV domain contained in a respective "stack" molecule. Column 3 shows the binding partners which the indicated affinity modified stacked domains from column 1 were selected against.

Also shown is the binding activity as measured by the Mean Fluorescence Intensity (MFI) value for binding of each stack molecule to cells engineered to express various counter structure ligands and the ratio of the MFI compared to the binding of the corresponding stack molecule containing unmodified IgV domains not containing the amino acid substitution(s) to the same cell-expressed counter structure ligand. The functional activity of the variant stack molecules to modulate the activity of T cells also is shown based on the calculated levels of IFN-gamma in culture supernatants (pg/ml) generated with the indicated variant stack molecule in solution and the appropriate ligand coimmoblized with anti-CD3 as described in Example 6. The Table also depicts the ratio of IFN-gamma produced by each variant stack molecule compared to the corresponding unmodified stack molecule in the coimmobilization assay.

As shown, the results showed that it was possible to generate stack molecules containing at least one variant IgSF domain that exhibited affinity-modified activity of increased binding for at least one cognate counter structure ligand compared to a corresponding stack molecule containing the respective unmodified (e.g. wild-type) IgV domain. In some cases, the stack molecule, either from one or a combination of both variant IgSF domains in the molecule, exhibited increased binding for more than one cognate counter structure ligand. The results also showed that the order of the IgV domains in the stacked molecules could, in some cases, alter the degree of improved binding activity. In some cases, functional T cell activity also was altered when assessed in the targeted coimmobilization assay.

TABLE 11

| Stacked variant IgV Fc fusion proteins containing an NKp30 IgV domain and a CD80 or CD86 IgV domain | | | | | |
|---|---|---|---|---|---|
| | | Counter | Binding Activity | | Anti-CD3 coimmobilization assay |
| Domain Structure N terminal to C terminal: domain 1/domain 2/Fc | SEQ ID NO (IgV) | structure selected against | B7H6 MFI (WT parental MFI ratio) | CD28 MFI (WT parental MFI ratio) | pg/ml IFN-gamma (WT parental IFN-gamma ratio) |
| Domain 1: NKp30 WT | 214 | — | 88823 (1.00) | 7022 (1.00) | 68 (1.00) |
| Domain 2: CD80 WT | 152 | | | | |
| Domain 1: NKp30 WT | 214 | — | 14052 (1.00) | 1690 (1.00) | 92 (1.00) |
| Domain 2: CD86 WT | 220 | | | | |

TABLE 11-continued

Stacked variant IgV Fc fusion proteins containing an NKp30 IgV domain and a CD80 or CD86 IgV domain

| Domain Structure N terminal to C terminal: domain 1/domain 2/Fc | SEQ ID NO (IgV) | Counter structure selected against | Binding Activity B7H6 MFI (WT parental MFI ratio) | Binding Activity CD28 MFI (WT parental MFI ratio) | Anti-CD3 coimmobilization assay pg/ml IFN-gamma (WT parental IFN-gamma ratio) |
|---|---|---|---|---|---|
| Domain 1: NKp30 (L30V A60V S64P S86G) | 215 | B7-H6 | 53279 (0.60) | 9027 (1.29) | 94 (1.38) |
| Domain 2: CD80 R29H/Y31H/T41G/Y87N/E88G/K89E/D90N/A91G/P109S | 192 | CD28 | | | |
| Domain 1: NKp30 (L30V A60V S64P S86G) | 215 | B7-H6 | 41370 (0.47) | 11240 (1.60) | 60 (0.88) |
| Domain 2: CD80 I67T/L70Q/A91G/T120S | 175 | CD28 | | | |
| Domain 1: NKp30 (L30V A60V S64P S86G)/ | 215 | B7-H6 | 68480 (4.87) | 9115 (5.39) | 110 (1.19) |
| Domain 2: CD86 Q35H/H90L/Q102H | 221 | CD28 | | | |
| Domain 1: CD80 WT | 152 | — | 110461 (1.00) | 13654 (1.00) | 288 (1.00) |
| Domain 2: Nkp30 WT | 214 | | | | |
| Domain 1: CD86 WT | 220 | CD28 | 128899 (1.00) | 26467 (1.00) | 213 (1.00) |
| Domain 2: Nkp30 WT | 214 | B7-H6 | | | |
| Domain 1: CD80 R29H/Y31H/T41G/Y87N/E88G/K89E/D90N/A91G/P109S | 192 | CD28 | 55727 (0.50) | 4342 (0.32) | 100 (0.35) |
| Domain 2: NKp30 (L30V A60V S64P S86G) | 215 | B7-H6 | | | |
| Domain 1: CD80 I67T/L70Q/A91G/T120S | 175 | CD28 | 40412 (0.37) | 7094 (0.52) | 84 (0.29) |
| Domain 2: NKp30 (L30V A60V S64P S86G) | 215 | B7-H6 | | | |
| Domain 1: CD86 Q35H/H90L/Q102H | 221 | CD28 | 220836 (1.71) | 11590 (0.44) | 113 (0.53) |
| Domain 2: NKp30 (L30V A60V S64P S86G) | 215 | B7-H6 | | | |

TABLE 12

Stacked variant IgV Fc fusion proteins containing a CD80 IgV domain and a CD80, CD86, or ICOSL IgV domain

| Domain Structure N terminal to C terminal: domain 1/domain 2/Fc | SEQ ID NO (IgV) | Counter structure selected against | Binding Activity CD28 MFI (WT parental MFI ratio) | Binding Activity PD-L1 MFI (WT parental MFI ratio) | Binding Activity ICOS MFI (WT parental MFI ratio) | Anti-CD3 coimmobilization assay pg/ml IFN-gamma (WT parental IFN-gamma ratio) |
|---|---|---|---|---|---|---|
| Domain 1: CD80 WT | 152 | | 1230 | 2657 | 11122 | 69 |
| Domain 2: ICOSL WT | 196 | | (1.00) | (1.00) | (1.00) | (1.00) |
| Domain 1: CD80 WT | 152 | | 60278 | 2085 | | 59 |
| Domain 2: CD86 WT | 220 | | (1.00) | (1.00) | | (1.00) |
| Domain 1: CD80 WT | 152 | | 1634 | 6297 | | 98 |
| Domain 2: CD80 WT | 152 | | (1.00) | (1.00) | | (1.00) |
| Domain 1: CD80 E88D/K89R/D90K/A91G/F92Y/K93R | 189 | PD-L1 | 4308 (2.64) | 4234 (0.67) | | 214 (2.18) |
| Domain 2: CD80 R29H/Y31H/T41G/Y87N/E88G/K89E/D90N/A91G/P109S | 192 | CD28 | | | | |
| Domain 1: CD80 A12T/H18L/M43V/F59L/E77K/P109S/I118T | 193 | PD-L1 | 7613 (4.66) | 2030 (0.32) | | 137 (1.40) |
| Domain 2: CD80 R29H/Y31H/T41G/Y87N/E88G/K89E/D90N/A91G/P109S | 192 | CD28 | | | | |

TABLE 12-continued

Stacked variant IgV Fc fusion proteins containing a CD80 IgV domain and a CD80, CD86, or ICOSL IgV domain

| Domain Structure N terminal to C terminal: domain 1/domain 2/Fc | SEQ ID NO (IgV) | Counter structure selected against | Binding Activity CD28 MFI (WT parental MFI ratio) | Binding Activity PD-L1 MFI (WT parental MFI ratio) | Binding Activity ICOS MFI (WT parental MFI ratio) | Anti-CD3 coimmobilization assay pg/ml IFN-gamma (WT parental IFN-gamma ratio) |
|---|---|---|---|---|---|---|
| Domain 1: CD80 A12T/H18L/M43V/F59L/E77K/P109S/I118T | 193 | PD-L1 | 3851 (2.36) | 3657 (0.58) | | 81 (0.83) |
| Domain 2: CD80 I67T/L70Q/A91G/T120S | 175 | CD28 | | | | |
| Domain 1: CD80 E88D/K89R/D90K/A91G/F92Y/K93R | 189 | PD-L1 | 4117 (0.07) | 2914 (1.40) | | 96 (1.63) |
| Domain 2: CD86 Q35H/H90L/Q102H | 221 | CD28 | | | | |
| Domain 1: CD80 A12T/H18L/M43V/F59L/E77K/P109S/I118T | 193 | PD-L1 | 2868 (0.05) | 3611 (1.73) | | 94 (1.60) |
| Domain 2: CD86 Q35H/H90L/Q102H | 221 | CD28 | | | | |
| Domain 1: CD80 E88D/K89R/D90K/A91G/F92Y/K93R | 189 | PD-L1 | 3383 (2.75) | 4515 (1.70) | 5158 (0.46) | 90 (1.30) |
| Domain 2: ICOSL N52S/N57Y/H94D/L96F/L98F/Q100R/G103E/F120S | 213 | ICOS/CD28 | | | | |
| Domain 1: CD80 A12T/H18L/M43V/F59L/E77K/P109S/I118T | 193 | PD-L1 | 2230 (1.81) | 2148 (0.81) | 3860 (0.35) | 112 (1.62) |
| Domain 2: ICOSL N52S/N57Y/H94D/L96F/L98F/Q100R/G103E/F120S | 213 | ICOS/CD28 | | | | |
| Domain 1: CD80 A12T/H18L/M43V/F59L/E77K/P109S/I118T | 193 | PD-L1 ICOS/CD28 | 5665 (4.61) | 6446 (2.43) | 15730 (1.41) | 126 (1.83) |
| Domain 2: ICOSL N52D | 199 | | | | | |
| Domain 1: CD80 E88D/K89R/D90K/A91G/F92Y/K93R | 189 | PD-L1 | 6260 (5.09) | 4543 (1.71) | 11995 (1.08) | 269 (3.90) |
| Domain 2: ICOSL N52H/N57Y/Q100P | 201 | ICOS/CD28 | | | | |
| Domain 1: CD80 A12T/H18L/M43V/F59L/E77K/P109S/I118T | 193 | PD-L1 | 3359 (2.73) | 3874 (1.46) | 8541 (0.77) | 97 (1.41) |
| Domain 2: ICOSL N52H/N57Y/Q100P | 201 | ICOS/CD28 | | | | |
| Domain 1: ICOSL WT | 196 | | 3000 | 2966 | 14366 | 101 |
| Domain 2: CD80 WT | 152 | | (1.00) | (1.00) | (1.00) | (1.00) |
| Domain 1: CD86 WT | 220 | | 4946 | 1517 | | 125 |
| Domain 2: CD80 WT | 152 | | (1.00) | (1.00) | | (1.00) |
| Domain 1: CD80 R29H/Y31H/T41G/Y87N/E88G/K89E/D90N/A91G/P109S | 192 | CD28 | 2832 (1.73) | 3672 (0.58) | | 114 (1.16) |
| Domain 2: CD80 E88D/K89R/D90K/A91G/F92Y/K93R | 189 | PD-L1 | | | | |
| Domain 1: CD80 R29H/Y31H/T41G/Y87N/E88G/K89E/D90N/A91G/P109S | 192 | CD28 | 4542 (2.78) | 2878 (0.45) | | 142 (1.45) |
| Domain 2: CD80 A12T/H18L/M43V/F59L/E77K/P109S/I118T | 193 | PD-L1 | | | | |
| Domain 1: CD80 I67T/L70Q/A91G/T120S | 175 | CD28 | 938 (0.57) | 995 (0.16) | | 102 (1.04) |
| Domain 2: CD80 E88D/K89R/D90K/A91G/F92Y/K93R | 189 | PD-L1 | | | | |

TABLE 12-continued

Stacked variant IgV Fc fusion proteins containing a CD80 IgV domain and a CD80, CD86, or ICOSL IgV domain

| Domain Structure N terminal to C terminal: domain 1/domain 2/Fc | SEQ ID NO (IgV) | Counter structure selected against | Binding Activity CD28 MFI (WT parental MFI ratio) | PD-L1 MFI (WT parental MFI ratio) | ICOS MFI (WT parental MFI ratio) | Anti-CD3 coimmobilization assay pg/ml IFN-gamma (WT parental IFN-gamma ratio) |
|---|---|---|---|---|---|---|
| Domain 1: CD80 I67T/L70Q/A91G/T120S | 175 | CD28 | 4153 (2.54) | 2827 (0.45) | | 108 (1.10) |
| Domain 2: CD80 A12T/H18L/M43V/F59L/E77K/P109S/I118T | 193 | PD-L1 | | | | |
| Domain 1: CD86 Q35H/H90L/Q102H | 221 | CD28 | 14608 (2.95) | 2535 (1.67) | | 257 (2.06) |
| Domain 2: CD80 E88D/K89R/D90K/A91G/F92Y/K93R | 189 | PD-L1 | | | | |
| Domain 1: CD86 Q35H/H90L/Q102H | 221 | CD28 | 2088 (0.42) | 2110 (1.39) | | 101 (0.81) |
| Domain 2: CD80 A12T/H18L/M43V/F59L/E77K/P109S/I118T | 193 | PD-L1 | | | | |
| Domain 1: ICOSL N52S/N57Y/H94D/L96F/L98F/Q100R/G103E/F120S | 213 | ICOS/CD28 | 3634 (1.21) | 4893 (1.65) | 6403 (0.45) | 123 (1.22) |
| Domain 2: CD80 E88D/K89R/D90K/A91G/F92Y/K93R | 189 | PD-L1 | | | | |
| Domain 1: ICOSL N52S/N57Y/H94D/L96F/L98F/Q100R/G103E/F120S | 213 | ICOS/CD28 | 1095 (0.37) | 5929 (2.0) | 7923 (0.55) | 127 (1.26) |
| Domain 2: CD80 A12T/H18L/M43V/F59L/E77K/P109S/I118T | 193 | PD-L1 | | | | |
| Domain 1: ICOSL N52D | 199 | ICOSL/CD28 | 2023 (0.67) | 5093 (1.72) | 16987 (1.18) | 125 (1.24) |
| Domain 2: CD80 E88D/K89R/D90K/A91G/F92Y/K93R | 189 | PD-L1 | | | | |
| Domain 1: ICOSL N52D | 199 | ICOS/CD28 | 3441 (1.15) | 3414 (1.15) | 20889 (1.45) | 165 (1.63) |
| Domain 2: CD80 A12T/H18L/M43V/F59L/E77K/P109S/I118T | 193 | PD-L1 | | | | |
| Domain 1: ICOSL N52H/N57Y/Q100P | 201 | ICOS/CD28 | 7835 (2.61) | 6634 (2.24) | 20779 (1.45) | 95 (0.94) |
| Domain 2: CD80 E88D/K89R/D90K/A91G/F92Y/K93R | 189 | PD-L1 | | | | |
| Domain 1: ICOSL N52H/N57Y/Q10013 | 201 | ICOS/CD28 | 8472 (2.82) | 3789 (1.28) | 13974 (0.97) | 106 (1.05) |
| Domain 2: CD80 A12T/H18L/M43V/F59L/E77K/P109S/I118T | 193 | PD-L1 | | | | |

TABLE 13

Stacked variant IgV Fc fusion proteins containing two CD80 IgV domains

| Domain Structure N terminal to C terminal: domain 1/domain 2/Fc | SEQ ID NO (IgV) | Counter structure selected against | Binding Activity PD-L1 MFI (WT parental MFI ratio) | CTLA-4 MFI (WT parental MFI ratio) | Functional Activity MLR IFN-gamma pg/ml |
|---|---|---|---|---|---|
| Domain 1: CD80 WT | 152 | | 6297 (1.00) | 4698 (1.00) | 35166 (1.00) |
| Domain 2: CD80 WT | 152 | | | | |
| Domain 1: CD80 V68M/L70P/L72P/K86E | 195 | CTLA-4 | 2464 (0.39) | 4955 (1.05) | 5705 (0.16) |
| Domain 2: CD80 E88D/K89R/D90K/A91G/F92Y/K93R | 189 | PD-L1 | | | |

TABLE 13-continued

Stacked variant IgV Fc fusion proteins containing two CD80 IgV domains

| Domain Structure N terminal to C terminal: domain 1/domain 2/Fc | SEQ ID NO (IgV) | Counter structure selected against | Binding Activity PD-L1 MFI (WT parental MFI ratio) | Binding Activity CTLA-4 MFI (WT parental MFI ratio) | Functional Activity MLR IFN-gamma pg/ml |
|---|---|---|---|---|---|
| Domain 1: CD80 R29V/Y31F/K36G/M38L/N43Q/ E81R/V83I/L85I/K89R/D90L/ A91E/F92N/K93Q/R94G | 194 | CTLA-4 | 1928 (0.31) | 1992 (0.42) | 1560 (0.04) |
| Domain 2: CD80 E88D/K89R/D90K/A91G/ F92Y/K93R | 189 | PD-L1 | | | |
| Domain 1: CD80 V68M/L70P/L72P/K86E | 195 | CTLA-4 | 1215 (0.19) | 1382 (0.29) | 2171 (0.06) |
| Domain 2: CD80 A12T/H18L/N43V/F59L/ E77K/P109S/I118T | 193 | PD-L1 | | | |
| Domain 1: CD80 R29V/Y31F/K36G/M38L/M43Q/ E81R/V83I/L85I/K89R/D90L/ A91E/F92N/K93Q/R94G | 194 | CTLA-4 | 1592 (0.25) | 1962 (0.42) | 1512 (0.04) |
| Domain 2: CD80 A12T/H18L/M43V/F59L/E77K/ P109S/I118T | 193 | PD-L1 | | | |
| Domain 1: CD80 E88D/K89R/D90K/A91G/ F92Y/K93R | 189 | PD-L1 | 1747 (0.28) | 2057 (0.44) | 9739 (0.28) |
| Domain 2: CD80 V68M/L70P/L72P/K86E | 195 | CTLA-4 | | | |
| Domain 1: CD80 E88D/K89R/D90K/A91G/ F92Y/K93R | 189 | PD-L1 | 1752 (0.28) | 1772 (0.38) | 5412 (0.15) |
| Domain 2: CD80 R29V/Y31F/K36G/M38L/M43Q/ E81R/V83I/L85I/K89R/D90L/ A91E/F92N/K93Q/R94G | 194 | CTLA-4 | | | |
| Domain 1: CD80 A12T/H18L/M43V/F59L/E77K/ P109S/I118T | 193 | PD-L1 | 1636 (0.26) | 1887 (0.40) | 7608 (0.22) |
| Domain 2: CD80 V68M/L70P/L72P/K86E | 195 | CTLA-4 | | | |
| Domain 1: CD80 A12T/H18L/M43V/F59L/E77K/ P109S/I118T | 193 | PD-L1 | 2037 (0.32) | 4822 (1.03) | 11158 (0.32) |
| Domain 2: CD80 R29V/Y31F/K36G/M38L/M43Q/ E81R/V83I/L85I/K89R/D90L/ A91E/F92N/K93Q/R94G | 194 | CTLA-4 | | | |

TABLE 14

Stacked variant IgV Fc fusion proteins containing a CD80 IgV domain and an ICOSL IgV domain

| Domain Structure N terminal to C terminal: domain 1/domain 2/Fc | SEQ ID NO (IgV) | Counter structure selected against | Binding Activity PD-L1 MFI (WT parental MFI ratio) | Binding Activity CTLA-4 MFI (WT parental MFI ratio) | Functional Activity MLR IFN-gamma pg/ml |
|---|---|---|---|---|---|
| Domain 1: CD80 WT | 152 | | 1230 (1.00) | 11122 (1.00) | 1756 (1.00) |
| Domain 2: ICOSL WT | 196 | | | | |
| Domain 1: CD80 R29H/Y31H/T41G/Y87N/E88G/ K89E/D90N/A91G/P109S | 192 | CD28 | 2280 (1.85) | 3181 (0.29) | 2281 (1.30) |
| Domain 2: ICOSL N52S/N57Y/H94D/L96F/L98F/ Q100R/G103E/F120S | 213 | ICOS/CD28 | | | |
| Domain 1: CD80 I67T/L70Q/A91G/T120S | 175 | CD28 | 2309 (1.88) | 26982 (2.43) | 1561 (0.89) |
| Domain 2: ICOSL N52S/N57Y/H94D/L96F/L98F/ Q100R/G103E/F120S | 213 | ICOS/CD28 | | | |

TABLE 14-continued

Stacked variant IgV Fc fusion proteins containing a CD80 IgV domain and an ICOSL IgV domain

| Domain Structure N terminal to C terminal: domain 1/domain 2/Fc | SEQ ID NO (IgV) | Counter structure selected against | Binding Activity PD-L1 MFI (WT parental MFI ratio) | Binding Activity CTLA-4 MFI (WT parental MFI ratio) | Functional Activity MLR IFN-gamma pg/ml |
|---|---|---|---|---|---|
| Domain 1: CD80 R29H/Y31H/T41G/Y87N/E88G/K89E/D90N/A91G/P109S | 192 | CD28 | 4285 (3.48) | 22744 (2.04) | 1612 (0.92) |
| Domain 2: ICOSL N52D | 199 | ICOS/CD28 | | | |
| Domain 1: CD80 I67T/L70Q/A91G/T120S | 175 | CD28 | 3024 (2.46) | 16916 (1.52) | 3857 (2.20) |
| Domain 2: ICOSL N52D | 199 | ICOS/CD28 | | | |
| Domain 1: CD80 R29H/Y31H/T41G/Y87N/E88G/K89E/D90N/A91G/P109S | 192 | CD28 | 6503 (5.29) | 7240 (0.65) | 6886 (3.92) |
| Domain 2: ICOSL N52H/N57Y/Q100P | 201 | ICOS/CD28 | | | |
| Domain 1: CD80 I67T/L70Q/A91G/T120S | 175 | CD28 | 3110 (2.53) | 4848 (0.44) | 3393 (1.93) |
| Domain 2: ICOSL N52H/N57Y/Q100P | 201 | ICOS/CD28 | | | |
| Domain 1: ICOSL WT | 196 | | 3000 (1.00) | 14366 (1.00) | 4113 (1.00) |
| Domain 2: CD80 WT | 152 | | | | |
| Domain 1: ICOSL N52S/N57Y/H94D/L96F/L98F/Q100R/G103E/F120S | 213 | ICOSL/CD28 | 10426 (3.48) | 51286 (3.57) | 18680 (4.54) |
| Domain 2: CD80 R29H/Y31H/T41G/Y87N/E88G/K89E/D90N/A91G/P109S | 192 | CD28 | | | |
| Domain 1: ICOSL N52S/N57Y/H94D/L96F/L98F/Q100R/G103E/F120S | 213 | ICOS/CD28 | 17751 (5.92) | 29790 (2.07) | 10637 (2.59) |
| Domain 2: CD80 I67T/L70Q/A91G/T120S | 175 | CD28 | | | |
| Domain 1: ICOSL N52D | 199 | ICOS/CD28 | 2788 (0.93) | 25870 (1.80) | 6205 (1.51) |
| Domain 2: CD80 R29H/Y31H/T41G/Y87N/E88G/K89E/D90N/A91G/P109S | 192 | CD28 | | | |
| Domain 1: ICOSL N52D | 199 | ICOS/CD28 | 2522 (0.84) | 13569 (0.94) | 5447 (1.32) |
| Domain 2: CD80 I67T/L70Q/A91G/T120S | 175 | CD28 | | | |
| Domain 1: ICOSL N52H/N57Y/Q100P | 201 | ICOS/CD28 | | | |
| Domain 2: CD80 R29H/Y31H/T41G/Y87N/E88G/K89E/D90N/A91G/P109S | 192 | CD28 | 9701 (3.23) | 9187 (0.64) | 5690 (1.38) |

Example 10

Generation and Assessment of Engineered Cells Expressing a Transmembrane Immunomodulatory Protein Engineered T cells were generated in which a transmembrane immunomodulatory protein (TIP) containing an extracellular domain (ECD) containing either a variant CD80 as described above or an ICOSL affinity-modified IgSF domain was co-expressed with a chimeric antigen receptor (CAR). The TIP also contained a transmembrane domain and a cytoplasmic domain of the corresponding wild-type CD80 or ICOSL transmembrane protein sequence. The immunomodulatory activity of the engineered cells was compared to cells that only expressed the CAR or cells that co-expressed the corresponding wild-type CD80 or ICOSL transmembrane protein with the CAR.

The exemplary CD80-TIP was a variant CD80 having an affinity-modified IgSF domain containing amino acid mutations in the IgV and IgC domains corresponding to I67T/L70Q/A91G/T120S with reference to positions in the CD80 extracellular domain set forth in SEQ ID NO:28 and a transmembrane and cytoplasmic domain corresponding to residues 243-288 of SEQ ID NO: 1. The amino acid sequence of the exemplary CD80-TIP is set forth in SEQ ID NO:241 and is encoded by the sequence of nucleotides set forth in SEQ ID NO:242. The corresponding wild-type CD80 transmembrane protein had the sequence of amino acids set forth as amino acid residues 35-288 of SEQ ID NO: 1 and encoded by the sequence of amino acids set forth in SEQ ID NO: 251.

The exemplary ICOSL-TIP was a variant ICOSL having an affinity-modified IgSF domain containing amino acid mutations in the IgV domain corresponding to N52H/I143T with reference to positions in the ICOSL extracellular domain set forth in SEQ ID NO:32 and a transmembrane and cytoplasmic domain corresponding to residues 257-302 of SEQ ID NO:5. The amino acid sequence of the exemplary ICOSL-TIP is set forth in SEQ ID NO:243 and is encoded by the sequence of nucleotides set forth in SEQ ID NO:244. The corresponding wild-type ICOSL transmembrane protein had the sequence of amino acids set forth as amino acid residues 19-302 of SEQ ID NO:5 and encoded by the sequence of amino acids set forth in SEQ ID NO: 252.

The TIP containing the affinity-modified domain or the wild-type transmembrane protein containing a corresponding non-affinity modified IgSF domain were co-expressed in T cells with a $1^{st}$ generation chimeric antigen receptor (CAR) containing a CD3zeta intracellular signaling domain. The $1^{st}$ generation CAR included an scFv specific for CD19 (SEQ ID NO:245), a hinge and transmembrane domain derived from CD8 (SEQ ID NO:246) and an intracellular signaling domain derived from CD3zeta (set forth in SEQ ID NO:247). The nucleotide sequence encoding the CD19 scFv-CD3zeta CAR is set forth in SEQ ID NO:248 and the amino acid sequence of the CD19 scFv-CD3zeta CAR is set forth in SEQ ID NO:479.

Nucleic acid molecules encoding the CAR alone or also encoding one of the exemplary TIPs or wild-type transmembrane proteins separated from the CAR by a self-cleaving T2A sequence (SEQ ID NO:250 and encoded by the sequence of nucleotides set forth in SEQ ID NO:249) were generated. Exemplary constructs contained nucleic acid sequences set forth in Table 15. As a control, a nucleic acid construct encoding a $2^{nd}$ generation CAR additionally containing a CD28 costimulatory domain also was generated (CD19 scFv-CD28-CD3zeta).

TABLE 15

Nucleic Acid Constructs

| | CAR (SEQ ID NO) | T2A Linker (SEQ ID NO) | TIP (SEQ ID NO) |
|---|---|---|---|
| CD19 scFv - CD3zeta | + (248) | — | — |
| CD19 scFv - CD3zeta - T2A - B7-1 | + (248) | + (249) | Wildtype CD80 (251) |
| CD19 scFv - CD3zeta - T2A - B7-1_TIP | + (248) | + (249) | CD80 TIP (242) |
| CD19 scFv - CD3zeta - T2A - ICOSL | + (248) | + (249) | Wildtype ICOSL (252) |
| CD19 scFv - CD3zeta - T2A - ICOSL_TIP | + (248) | + (249) | ICOSL TIP (244) |

The nucleic acid molecules were individually cloned into a lentiviral vector, which was used to transduce T cells isolated from human PBMC samples obtained from three different healthy donors. Lentivirus particles containing the nucleic acid sequences were produced after co-transfection of HEK293 cells with the vectors and lentivirus packaging constructs. The lentivirus particles were collected from the culture medium by ultracentrifugation and titered by qRT-PCR. Human peripheral blood mononuclear cells (PBMC) were isolated from three normal blood donors using density sedimentation. The PBMC were cultured overnight with anti-CD3 and anti-CD28 antibodies and IL-2, and then transduced with the lentivirus preparations at a multiplicity of infection of 5:1. The lentiviral vectors encoding the control 2nd generation CAR was only used to transduce cells from one donor.

After two weeks (14 days) of culture, the cells were analyzed for cytotoxicity following co-culture with target antigen-expressing cells using the Acea Real-Time Cell Analyzer (RTCA), which measures the impedance variations in the culture media of a 96-well microelectronic plate (E-plate), and shows the changes in cell number and morphology in a real-time plot. CD19-expressing HeLa target cells (HeLa-CD19) were seeded into a 96-well E-plate and the impedance of each monolayer was monitored for 24 hours using the RTCA system. The engineered T cells were added to the wells at an effector:target ratio of 10:1 and the wells were monitored for another 48 hours. The results were displayed and recorded as Cell Index (CI) value derived from the change in measured electrical impedance and were then ratio transformed by dividing the CI readouts of all wells at all time points over the CI value of individual wells at a same time (base-time) to obtain a normalized cell index value representing the percentage of the value at the base-time (see Zhang et al. "Introduction to the Data Analysis of the Roche xCELLigence®System with RTCA Package." *Bioconductor*. May 3, 2016, bioconductor.org/packages/devel/bioc/vignettes/RTCA/inst/doc/aboutRTCA.pdf. Accessed Sep. 9, 2016). In this assay, a decrease in the impedance of a monolayer reflects killing of the target cells by the transduced cells.

The results showed that decreased impedance was observed in cells expressing the $1^{st}$ generation CAR compared to non-transduced T cells, although the degree of decreased impedance for cells expressing the $1^{st}$ generation CAR was less than cells expressing the $2^{nd}$ generation CAR. The decreased impedance in cells expressing the $1^{st}$ generation CAR continued generally for up to the first 8 hours of the assay, while only the $2^{nd}$ generation CAR-expressing cells continued to decrease the impedance thereafter.

Figure 8:
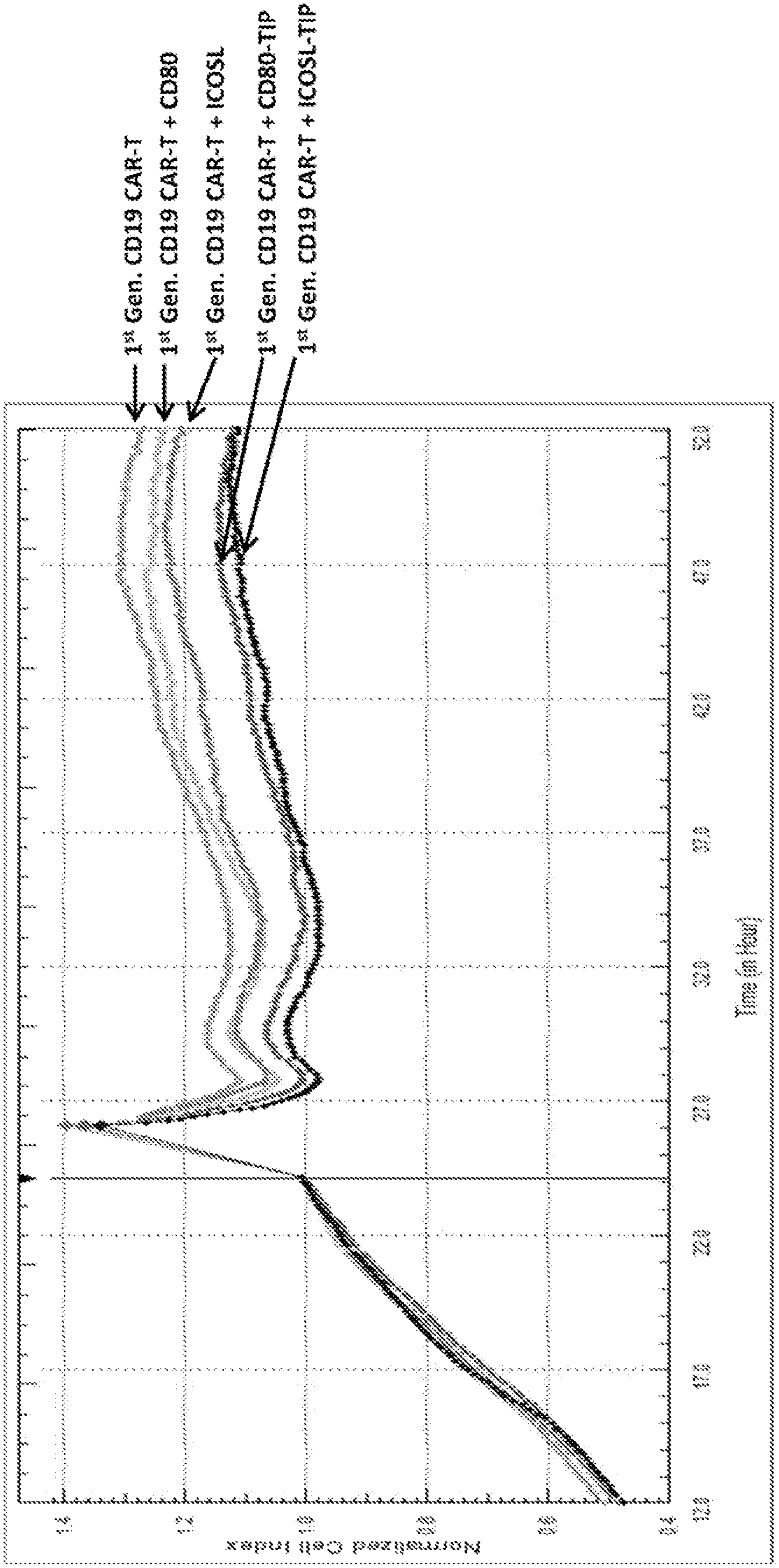
FIG. 8 depicts impedance results reflecting cytotoxic killing activity of cells engineered with an anti-CD19 chimeric antigen receptor (CAR) alone or with an exemplary transmembrane immunomodulatory TIP (CD80-TIP or ICOSL-TIP) or the corresponding CD80 or ICOSL wild-type transmembrane protein following co-culture with target antigen-expressing cells. Impedance was assessed using the Acea Real-Time Cell Analyzer (RTCA), which measures the impedance variations in the culture media of a 96-well microelectronic plate (E-plate).

As shown in FIG. 8, in one donor, each of the cells co-expressing the TIP or corresponding wild-type transmembrane protein with the $1^{st}$ generation CAR exhibited a greater decrease in impedance, indicating greater cytotoxic activity, compared to cells only expressing the $1^{st}$ generation CAR. Further, the results showed that the cytotoxic activity was greater in CAR-expressing cells that co-expressed the CD80-TIP or ICOSL-TIP relative to CAR-expressing cells that co-expressed the corresponding wild-type CD80 or ICOSL transmembrane proteins containing a non-affinity modified IgSF domain. The observed results of these TIP-engineered cells showed that cytotoxic activity in cells co-expressing the CD80-TIP or ICOSL-TIP with the CAR exhibit increased activity to modulate the cytotoxic immune response of antigen-specific T cells, such as the CAR-expressing T cells.

In the other two donors, the cells expressing the CD80-TIP did not result in a greater decreased impedance compared to cells expressing the corresponding wild-type CD80 transmembrane protein. In one donor, there were not enough cells to transduce with the wild-type transmembrane protein construct, although in this donor the ICOS-L TIP gave the best cytotoxicity compared to the other constructs tested. In the other donor, the cells expressing the ICOS-L-TIP did not result in a greater decreased impedance compared to cells expressing the corresponding wild-type ICOS-L transmembrane protein. In the tested cells, all cells co-expressing either a CD80-TIP, ICOSL-TIP or corresponding wild type transmembrane protein with the CAR exhibited greater cytotoxic activity than cells only expressing the 1st generation CAR. The differences in the results observed among donors may be related to the differences in the T cells among the donors, differences in expression levels of the various engineered proteins on the surface of the cells, the particular conditions used in this exemplary assay for assessing killing in cells (e.g. assessing Day 14 transduced cells, assessing a single effector:target cell ratio) or other factors.

Example 11

Assessment of Binding and Activity of CD80 IgSF Domain Variants

Additional ECD CD80 variants were identified and were used to produce ECD-Fc fusion proteins as described in Example 5. Binding studies were performed to assess specificity and affinity of CD80 domain variant immunomodulatory proteins for cognate binding partners substantially as described in Example 6. Exemplary results for the additional CD80 IgSF domain variants for binding to cell-expressed counter structures and bioactivity from an anti-CD3 coimmobilization assay are set forth in Table 16.

The exemplary amino acid substitutions depicted in Table 16 are designated by amino acid position number corresponding to the respective reference unmodified CD80 ECD sequence set forth in SEQ ID NO:28. The amino acid position is indicated in the middle, with the corresponding unmodified (e.g. wild-type) amino acid listed before the number and the identified variant amino acid substitution listed after the number. Column 2 sets forth the SEQ ID NO identifier for the variant ECD for each variant ECD-Fc fusion molecule. Also shown is the binding activity as measured by the Mean Fluorescence Intensity (MFI) value for binding of each variant Fc-fusion molecule to cells engineered to express the cognate counter structure ligand and the ratio of the MFI compared to the binding of the corresponding unmodified ECD-Fc fusion molecule not containing the amino acid substitution(s) to the same cell-expressed counter structure ligand. The functional activity of the variant Fc-fusion molecules to modulate the activity of T cells also is shown based on the calculated levels of IFN-gamma, and the ratio of IFN-gamma compared to the corresponding unmodified (parental) ECD-Fc, in culture supernatants (pg/ml) generated with the indicated variant ECD-Fc fusion molecule coimmoblized with anti-CD3. The results show altered, including increased, binding affinity of affinity-modified CD80 IgSF domain variants for at least one cognate counter structure ligand and/or improved immunological activity.

TABLE 16

CD80 variants selected against CTLA-4 or PD-L1. Molecule sequences, binding data, and costimulatory bioactivity data.

| CD80 mutation(s) | SEQ ID NO (ECD) | CD28 tfxn MFI (parental ratio) | CTLA-4 tfxn MFI (parental ratio) | PD-L1 tfxn MFI (parental ratio) | Anti-CD3 IFN-gamma Coimmobilization Assay pg/ml (parental ratio) |
|---|---|---|---|---|---|
| R29D, Y31L, Q33H, K36G, M38I, T41A, M43R, M47T, E81V, L85R, K89N, A91T, F92P, K93V, R94L, I118V, T120S, I127T, T130A, K169E | 446 | 3536 (0.08) | 5731 (0.01) | 173405 (0.08) | 109 (0.24) |
| R29D, Y31L, Q33H, K36G, M38I, T41A, M43R, M47T, L70Q, E81V, L85R, K89N, A91T, F92P, K93V, R94L, I118V, T120S, I127T, T130A, | 447 | 4962 (0.11) | 2027 (0.01) | 626341 (0.11) | 162 (0.36) |
| H18L, R29D, Y31L, Q33H, K36G, M38I, T41A, M43R, M47T, E81V, L85R, K89N, A91T, F92P, K93V, R94L, I118V, T120S, I127T, T130A, K169E | 448 | 3489 (0.08) | 2521 (0.01) | 215826 (0.08) | 206 (0.46) |
| R29D, Y31L, Q33H, K36G, M38I, T41A, M43R, M47T, E81V, L85R, K89N, A91T, F92P, K93V, R94L, I118V, T120S, T130A, K169E, M174T | 449 | 2736 (0.06) | 2493 (0.01) | 157897 (0.06) | 141 (0.31) |
| R29D, Y31L, Q33H, K36G, M38I, T41A, M43R, M47T, N48D, F59L, E81V, L85R, K89N, A91T, F92P, K93V, R94L, I118V, T120S, I127T, T130A, H188D | 450 | 2393 (0.05) | 2663 (0.01) | 137062 (0.05) | 230 (0.51) |
| H18R, R29D, Y31L, Q33H, K36G, K37E, M38I, T41A, M43R, M47T, L70Q, E81V, L85R, K89N, A91T, F92P, K93V, R94L, I118V, T120S, T130A, K169E, H188D | 451 | 3023 (0.07) | 2303 (0.01) | 158977 (0.07) | 305 (0.68) |
| R29D, Y31L, Q33H, K36G, M38I, T41A, M43R, M47T, L70Q, E81V, L85R, K89N, A91T, F92P, K93V, R94L, I118V, T120S, I127T, T130A, E143G, K169E, M174V, H188D | 452 | 2135 (0.05) | 2816 (0.01) | 374117 (0.05) | 291 (0.65) |
| R29D, Y31L, Q33H, K36G, M38I, T41A, M43R, M47T, E81V, L85R, K89N, A91T, F92P, K93V, R94L, I118V, T120S, I127T, T130A, K169E | 446 | 2157 (0.05) | 2819 (0.01) | 114963 (0.05) | 197 (0.44) |
| R29D, Y31L, Q33H, K36G, M38I, T41A, M43R, M47T, L70Q, E81V, L85R, K89N, A91T, F92P, K93V, R94L, I118V, T120S, I127T, T130A | 447 | 2126 (0.05) | 2377 (0.01) | 530029 (0.05) | 135 (0.30) |
| R29D, I30V, Y31L, Q33H, K36G, M38I, T41A, M43R, M47T, E81V, L85R, K89N, A91T, F92P, K93V, R94L, I118V, T120S, I127T, T130A, H188D | 453 | 1914 (0.04) | 2024 (0.01) | 179536 (0.04) | 127 (0.28) |

TABLE 16-continued

CD80 variants selected against CTLA-4 or PD-L1. Molecule sequences, binding data, and costimulatory bioactivity data.

| CD80 mutation(s) | SEQ ID NO (ECD) | CD28 tfxn MFI (parental ratio) | CTLA-4 tfxn MFI (parental ratio) | PD-L1 tfxn MFI (parental ratio) | Anti-CD3 IFN-gamma Coimmobilization Assay pg/ml (parental ratio) |
|---|---|---|---|---|---|
| R29D, Y31L, Q33H, K36G, M38I, T41A, M43R, M47T, L70Q, E81V, L85R, K89N, A91T, F92P, K93V, R94L, I118V, T120S, I127T, T130A, K169E | 455 | 2377 (0.05) | 2177 (0.01) | 438352 (0.05) | 203 (0.45) |
| R29D, Y31L, Q33H, K36G, M38I, T41A, M43R, M47T, L70Q, E81V, K89N, A91T, F92P, K93V, R94L, I118V, T120S, I127T, T130A | 456 | 2106 (0.05) | 2122 (0.01) | 14201 (0.05) | 226 (0.50) |
| R29D, Y31L, Q33H, K36G, M38I, T41A, M43R, M47T, L85R, K89N, A91T, F92P, K93V, R94L, I118V, T120S, I127T, T130A, K169E, H188D | 457 | 1887 (0.04) | 2201 (0.01) | 110092 (0.04) | 231 (0.51) |
| R29D, I30V, Y31L, Q33H, K36G, M38I, T41A, M43R, M47T, E81V, L85R, K89N, A91T, F92P, K93V, R94L, I118V, T120S, I127T, T130A, H188D | 453 | 2060 (0.05) | 2385 (0.01) | 94786 (0.05) | 237 (0.53) |
| R29D, Y31L, Q33H, K36G, M38I, T41A, M43R, M47T, E81V, L85R, K89N, A91T, F92P, K93V, R94L, F108L, I118V, T120S, T130A, K169E, H188D | 458 | 2009 (0.04) | 2623 (0.01) | 110589 (0.04) | 165 (0.37) |
| R29D, Y31L, Q33H, K36G, M38I, T41A, M43R, M47T, L70Q, E81V, L85R, K89N, A91T, F92P, K93V, R94L, T130A, H188D | 293 | 1925 (0.04) | 2979 (0.01) | 379558 (0.04) | 213 (0.47) |
| R29D, Y31L, Q33H, K36G, M38I, T41A, M43R, M47T, L70Q, E81V, L85R, K89N, A91T, F92P, K93V, R94L, I118V, T120S, T130A, N149D, K169E, H188D | 459 | 2245 (0.05) | 2842 (0.01) | 631549 (0.05) | 118 (0.26) |
| H18L, R29D, Y31L, Q33H, K36G, M38I, T41A, M43R, M47T, L70Q, E81V, L85R, K89N, A91T, F92P, K93V, R94L, I118V, T120S, T130A, K169E, H188D | 460 | 2759 (0.06) | 2247 (0.01) | 760438 (0.06) | 157 (0.35) |
| R29D, Y31L, Q33H, K36G, M38I, T41A, M43R, M47T, E81V, L85R, K89N, A91T, F92P, K93V, R94L, I118V, T120S, I127T, C128Y, T130A, H188D | 461 | 1585 (0.03) | 2736 (0.01) | 456003 (0.03) | 278 (0.62) |
| R29D, Y31L, Q33H, K36G, M38I, T41A, M43R, M47T, E81V, L85R, K89N, A91T, F92P, K93V, R94F, T130A, K169E | 297 | 2633 (0.06) | 3379 (0.01) | 133095 (0.06) | 190 (0.42) |
| H18L, R29D, Y31L, Q33H, K36G, M38I, T41A, M43R, M47T, E81V, L85R, K89N, A91T, F92P, K93V, R94L, E99D, T130A | 462 | 1732 (0.04) | 2082 (0.01) | 117465 (0.04) | 174 (0.39) |
| H18L, R29D, Y31L, Q33H, K36G, M38I, T41A, M43R, M47T, L70Q, E81V, L85R, K89N, A91T, F92P, K93V, R94L, I118V, T120S, T130A, K169E | 463 | 2011 (0.04) | 2502 (0.01) | 711479 (0.04) | 232 (0.51) |
| R29D, Y31L, Q33H, K36G, M38I, T41A, M43R, M47T, L70Q, E81V, L85R, K89N, A91T, F92P, K93I, R94L, L97R, T130A | 300 | 2026 (0.04) | 2443 (0.01) | 572017 (0.04) | 202 (0.45) |
| R29D, Y31L, Q33H, K36G, M38I, T41A, M43R, M47T, L70Q, E81V, L85R, K89N, A91T, F92P, K93I, R94L, L97R, T130A, L148S | 301 | 1296 (0.03) | 2119 (0.01) | 777509 (0.03) | 101 (0.22) |
| H18L, R29D, Y31L, Q33H, K36G, M38I, T41A, M43R, M47T, E81V, L85R, K89N, A91T, F92P, K93V, R94L, I118V, T120S, I127T, T130A, K169E | 302 | 1188 (0.03) | 2161 (0.01) | 190176 (0.03) | 97 (0.22) |

TABLE 16-continued

CD80 variants selected against CTLA-4 or PD-L1. Molecule sequences, binding data, and costimulatory bioactivity data.

| CD80 mutation(s) | SEQ ID NO (ECD) | CD28 tfxn MFI (parental ratio) | CTLA-4 tfxn MFI (parental ratio) | PD-L1 tfxn MFI (parental ratio) | Anti-CD3 IFN-gamma Coimmobilization Assay pg/ml (parental ratio) |
|---|---|---|---|---|---|
| R29D, Y31L, Q33H, K36G, M38I, T41A, M43R, M47T, I61N, E81V, L85R, K89N, A91T, F92P, K93V, R94F, V104A, I118V, T120S, I126V, T130A | 464 | 1203 (0.03) | 1863 (0.01) | 217243 (0.03) | 288 (0.64) |
| R29D, Y31L, Q33H, K36G, M38I, T41A, M43R, M47T, E81V, L85R, K89N, A91T, F92P, K93V, R94F, I118V, T120S, T130A | 465 | 1289 (0.03) | 2625 (0.01) | 124188 (0.03) | 111 (0.25) |
| R29D, Y31L, Q33H, K36G, M38I, T41A, M43R, M47T, T62S, E81V, L85R, K89N, A91T, F92P, K93V, R94L, I118V, T120S, T130A, K169E, T175A | 466 | 1228 (0.03) | 1973 (0.01) | 145285 (0.03) | 114 (0.25) |
| H18L, R29D, Y31L, Q33H, K36G, M38I, T41A, M43R, M47T, E81V, L85R, K89N, A91T, F92P, K93V, R94L, F116S, T130A, H188D | 306 | 1244 (0.03) | 2091 (0.01) | 109646 (0.03) | 114 (0.25) |
| H18L, R29D, Y31L, Q33H, K36G, M38I, T41A, M43R, M47T, E81V, L85R, K89N, A91T, F92P, K93V, R94L, I118V, T120S, I127T, T130A, L142S, H188D | 467 | 1221 (0.03) | 2251 (0.01) | 89654 (0.03) | 143 (0.32) |
| C16S, H18L, R29D, Y31L, Q33H, K36G, M38I, T41A, M43R, M47T, E81V, L85R, K89N, A91T, F92P, K93V, R94L, T110A, I118V, H188D | 468 | 1212 (0.03) | 1800 (0.01) | 4497 (0.03) | 247 (0.55) |
| R29D, Y31L, Q33H, K36G, M38I, T41A, M43R, M47T, A91G, I118V, T120S, I127T, T130A, H188D | 469 | 2620 (0.06) | 2241 (0.01) | 66183 (0.06) | 125 (0.28) |
| R29D, Y31L, Q33H, K36G, M38I, T41A, M43R, M47T, L70Q, D76G, A91G, S103L, I118V, T120S, I127T, T130A | 470 | 1907 (0.04) | 1726 (0.01) | 3508 (0.04) | 224 (0.50) |
| Y53C, L85R, K89N, A91T, F92P, K93V, R94L, I118V, T120S, I127T, T130A, K169E | 471 | 1396 (0.03) | 1459 (0.01) | 2552 (0.03) | 75 (0.17) |
| T62S, E81V, L85R, K89N, A91T, F92P, K93V, R94L, I118V, T120S, T130A, K169E | 472 | 2947 (0.06) | 2377 (0.01) | 179622 (0.06) | 107 (0.24) |
| L70Q, A91G, I118V, T120S, T130A, K169E | 417 | 12262 (0.27) | 90597 (0.01) | 4168 (0.27) | 115 (0.25) |
| R29D, Y31L, Q33H, K36G, M38I, T41A, M43R, M47T, E81V, L85R, K89N, A91T, F92P, K93V, R94L, S129L, H188D | 313 | 1696 (0.04) | 9960 (0.01) | 4067 (0.04) | 87 (0.19) |
| Y53C/L70Q/D90G/T130A/N149D/N152T/H188D | 473 | 1990 (0.04) | 3106 (0.01) | 3289 (0.04) | 122 (0.27) |
| WT CD80 | 28 | 45607 (1.00) | 883950 (1.00) | 93079 (1.00) | 451 (1.00) |
| H18L, R29D, Y31L, Q33H, K36G, M38I, T41A, M43R, M47T, E81V, L85R, K89N, A91T, F92P, K93V, R94L, I118V, T120S, I127T, T130A, H188D | 474 | 16232 (0.26) | 140241 (0.88) | 182403 (2.61) | 108 (0.96) |
| K89E, T130A | 73 | 46923 (0.75) | 225651 (1.41) | 196544 (2.82) | 317 (2.81) |
| K89E, K93E, T130A | 316 | 39137 (0.63) | 181037 (1.13) | 206713 (2.96) | 571 (5.06) |
| K89E, T130A | 73 | 61349 (0.99) | 156244 (0.98) | 126961 (1.82) | 2539 (22.53) |
| WT CD80 | 28 | 62220 (1.00) | 160148 (1.00) | 69786 (1.00) | 113 (1.00) |
| S21P, R29D, Y31L, Q33H, K36G, M38I, T41A, M43R, M47T, N48I, V68A, E81V, L85R, K89N, A91T, F92P, K93V, R94L, P109H, I126L, K169I | 317 | 4467 (0.20) | 4434 (0.02) | 146638 (5.87) | 137 (0.65) |

TABLE 16-continued

CD80 variants selected against CTLA-4 or PD-L1. Molecule sequences, binding data, and costimulatory bioactivity data.

| CD80 mutation(s) | SEQ ID NO (ECD) | CD28 tfxn MFI (parental ratio) | CTLA-4 tfxn MFI (parental ratio) | PD-L1 tfxn MFI (parental ratio) | Anti-CD3 IFN-gamma Coimmobilization Assay pg/ml (parental ratio) |
|---|---|---|---|---|---|
| H18L, R29D, Y31L, Q33H, K36G, M38I, T41A, M43R, M47T, P74L, Y80N, E81V, L85R, K89N, A91T, F92P, K93V, R94L, L97R | 318 | 4523 (0.21) | 4565 (0.02) | 4731 (0.19) | 18 (0.09) |
| R29D, Y31L, Q33H, K36G, M38I, T41A, M43R, M47T, E81V, L85R, K89N, A91T, F92P, K93V, R94L, S21P, P74L, Y80N, D90N, T130A, N149S, E162G | 319 | 4675 (0.21) | 4686 (0.02) | 4098 (0.16) | 54 (0.26) |
| R29D, Y31L, Q33H, K36G, M38I, T41A, M43R, M47T, E81V, L85R, K89N, A91T, F92P, K93V, R94L, H18L, V68M, T130A | 320 | 4413 (0.20) | 4618 (0.02) | 221788 (8.88) | 51 (0.24) |
| R29D, Y31L, Q33H, K36G, M38I, T41A, M43R, M47T, E81V, L85R, K89N, A91T, F92P, K93V, R94L, V68M, T130A, N149S, R190S | 321 | 4354 (0.20) | 4413 (0.02) | 201513 (8.06) | 80 (0.38) |
| R29D, Y31L, Q33H, K36G, M38I, T41A, M43R, M47T, E81V, L85R, K89N, A91T, F92P, K93V, R94L, H18L, P74L, Y80N, T130A, R190S | 322 | 4381 (0.20) | 4491 (0.02) | 5075 (0.20) | 8 (0.04) |
| C16G, V22A, R29D, Y31L, Q33H, K36G, M38I, T41A, M43R, M47T, E81V, L85R, K89N, A91T, F92P, K93V, R94L, V68M, D76G, I118T, T130A, S140T, N149S, K169I, H178R, N192D | 323 | 4459 (0.20) | 4582 (0.02) | 4383 (0.18) | 45 (0.21) |
| R29D, Y31L, Q33H, K36G, M38I, T41A, M43R, M47T, E81V, L85R, K89N, A91T, F92P, K93V, R94F, E117V, I118T, N149S, S168G, H188Q | 324 | 4371 (0.20) | 4613 (0.02) | 247135 (9.89) | 61 (0.29) |
| V22A, R29D, Y31L, Q33H, K36G, M38I, T41A, M43R, M47T, E81V, L85R, K89N, A91T, F92P, K93V, R94L, V68M, T130A | 325 | 4222 (0.19) | 4381 (0.022) | 235307 (9.42) | 96 (0.46) |
| R29D, Y31L, Q33H, K36G, M38I, T41A, M43R, M47T, E81V, L85R, K89N, A91T, F92P, K93V, R94F, N64S, I118T, T130A, N149S, K169I | 326 | 4216 (0.19) | 4305 (0.022) | 149085 (5.97) | 30 (0.14) |
| R29D, Y31L, Q33H, K36G, M38I, T41A, M43R, M47T, E81V, L85R, K89N, A91T, F92P, K93V, R94L, V22A, V68M, D115G, I118T, T130A, G133D, N149S | 327 | 4361 (0.20) | 4459 (0.022) | 95558 (3.82) | 88 (0.42) |
| S129P | 328 | 4458 (0.20) | 5914 (0.03) | 6669 (0.27) | 0 (0.0) |
| A91G, S129P | 329 | 5144 (0.23) | 26635 (0.12) | 13569 (0.54) | 0 (0.0) |
| I69T, L70Q, A91G, T120S | 330 | 74296 (3.37) | 203363 (0.89) | 6242 (0.25) | 509 (2.42) |
| S129P | 328 | 5086 (0.23) | 8957 (0.04) | 6603 (0.26) | 125 (0.60) |
| Y31H, S129P | 331 | 4553 (0.21) | 4874 (0.02) | 5788 (0.23) | 76 (0.36) |
| WT CD80 | 28 | 22053 (1.00) | 227691 (1.00) | 24989 (1.00) | 211 (1.00) |
| T28A, R29D, Y31L, Q33H, K36G, M38I, T41A, M43R, M47T, E81V, L85R, K89N, A91T, F92P, K93V, R94L, V104L, T130A, N149S | 332 | 2636 (0.17) | 2169 (0.03) | 99658 (9.45) | 116 (0.62) |
| H18L, R29D, Y31L, Q33H, K36G, M38I, T41A, M43R, M47T, E81V, L85R, K89N, A91T, F92P, K93V, R94L, L97R, N149S, H188Q | 333 | 2680 (0.17) | 2165 (0.03) | 107747 (10.22) | 125 (0.68) |

TABLE 16-continued

CD80 variants selected against CTLA-4 or PD-L1. Molecule sequences, binding data, and costimulatory bioactivity data.

| CD80 mutation(s) | SEQ ID NO (ECD) | CD28 tfxn MFI (parental ratio) | CTLA-4 tfxn MFI (parental ratio) | PD-L1 tfxn MFI (parental ratio) | Anti-CD3 IFN-gamma Coimmobilization Assay pg/ml (parental ratio) |
|---|---|---|---|---|---|
| H18L, R29D, Y31L, Q33H, K36G, M38I, T41A, M43R, M47T, E81V, L85R, K89N, A91T, F92P, K93V, R94L, L97R, T130A, N149S | 475 | 2482 (0.16) | 2179 (0.03) | 100116 (9.50) | 96 (0.52) |
| R29D, Y31L, Q33H, K36G, M38I, T41A, M43R, M47T, E81V, L85R, K89N, A91T, F92P, K93V, R94L, H18L, V68A, T130A, N149S, T154I | 335 | 2455 (0.15) | 2084 (0.03) | 11855 (1.12) | 132 (0.71) |
| R29D, Y31L, Q33H, K36G, M38I, T41A, M43R, M47T, E81V, L85R, K89N, A91T, F92P, K93V, R94L, A12G, V68A, L97R, T130A, L183H | 336 | 2804 (0.18) | 2310 (0.03) | 216297 (20.51) | 191 (1.03) |
| R29D, Y31L, Q33H, K36G, M38I, T41A, M43R, M47T, E81V, L85R, K89N, A91T, F92P, K93V, R94L, I118T, T130A, S140T, N149S, K169S | 337 | 2460 (0.15) | 2188 (0.03) | 109263 (10.36) | 150 (0.81) |
| R29D, Y31L, Q33H, K36G, M38I, T41A, M43R, M47T, E81V, L85R, K89N, A91T, F92P, K93V, R94L, I118T, T130A, N149S, K169I, Q193L | 338 | 2569 (0.16) | 2198 (0.03) | 100074 (9.49) | 130 (0.70) |
| R29D, Y31L, Q33H, K36G, M38I, T41A, M43R, M47T, E81V, L85R, K89N, A91T, F92P, K93V, R94L, V22A, I118T, T130A, N149S | 339 | 2500 (0.16) | 2188 (0.03) | 147900 (14.03) | 124 (0.67) |
| R29D, Y31L, Q33H, K36G, M38I, T41A, M43R, M47T, E81V, L85R, K89N, A91T, F92P, K93V, R94L, I118T, T130A, N149S | 340 | 2615 (0.16) | 2210 (0.03) | 118150 (11.21) | 89 (0.48) |
| R29D, Y31L, Q33H, K36G, M38I, T41A, M43R, M47T, E81V, L85R, K89N, A91T, F92P, K93V, R94L, I118T, T130A, N149S, K169I | 341 | 2444 (0.15) | 2246 (0.03) | 115420 (10.95) | 101 (0.55) |
| R29D, Y31L, Q33H, K36G, M38I, T41A, M43R, M47T, E81V, L85R, K89N, A91T, F92P, K93V, R94F, T130A, N149S, K169I | 342 | 2378 (0.15) | 2123 (0.03) | 112712 (10.69) | 114 (0.61) |
| I118T, C128R | 343 | 3093 (0.19) | 3180 (0.03) | 2620 (0.25) | 122 (0.66) |
| Q27R, R29C, M42T, S129P, E160G | 344 | 2827 (0.18) | 2623 (0.03) | 2326 (0.22) | 139 (0.75) |
| S129P, T154A | 345 | 3062 (0.19) | 2622 (0.03) | 2606 (0.25) | 156 (0.84) |
| WT CD80 | 28 | 15948 (1.00) | 75099 (1.00) | 10544 (1.00) | 185 (1.00) |

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

SEQUENCE LISTING (478 sequences)

SEQ ID NO: 1 - protein, 288 aa, Homo sapiens
  MISC_FEATURE: CD80(B7-1)
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 2 - protein, 329 aa, Homo sapiens
  MISC_FEATURE: CD86(B7-2)
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 3 - protein, 290 aa, Homo sapiens
  MISC_FEATURE: CD274 (PD-L1, B7-H1)
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 4 - protein, 273 aa, Homo sapiens
  MISC_FEATURE: PDCD1LG2(PD-L2, CD273)
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 5 - protein, 302 aa, Homo sapiens
  MISC_FEATURE: ICOSLG(B7RP1, CD275, ICOSL, B7-H2)
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 6 - protein, 534 aa, Homo sapiens
  MISC_FEATURE: CD276(B7-H3)
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 7 - protein, 282 aa, Homo sapiens
  MISC_FEATURE: VTCN1(B7-H4)
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 8 - protein, 220 aa, Homo sapiens
  MISC_FEATURE: CD28
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 9 - protein, 223 aa, Homo sapiens
  MISC_FEATURE: CTLA4
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 10 - protein, 288 aa, Homo sapiens
  MISC_FEATURE: PDCD1(PD-1)
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 11 - protein, 199 aa, Homo sapiens
  MISC_FEATURE: ICOS
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 12 - protein, 289 aa, Homo sapiens
  MISC_FEATURE: BTLA(CD272)
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 13 - protein, 458 aa, Homo sapiens
  MISC_FEATURE: CD4
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 14 - protein, 235 aa, Homo sapiens
  MISC_FEATURE: CD8A(CD8-alpha)
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 15 - protein, 210 aa, Homo sapiens
  MISC_FEATURE: CD8B(CD8-beta)
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 16 - protein, 525 aa, Homo sapiens
  MISC_FEATURE: LAG3
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 17 - protein, 301 aa, Homo sapiens
  MISC_FEATURE: HAVCR2(TIM-3)
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 18 - protein, 526 aa, Homo sapiens
  MISC_FEATURE: CEACAM1
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 19 - protein, 244 aa, Homo sapiens
  MISC_FEATURE: TIGIT
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 20 - protein, 417 aa, Homo sapiens
  MISC_FEATURE: PVR(CD155)
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 21 - protein, 538 aa, Homo sapiens
  MISC_FEATURE: PVRL2(CD112)
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 22 - protein, 336 aa, Homo sapiens
  MISC_FEATURE: CD226
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 23 - protein, 351 aa, Homo sapiens
  MISC_FEATURE: CD2
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 24 - protein, 180 aa, Homo sapiens
  MISC_FEATURE: CD160
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 25 - protein, 278 aa, Homo sapiens
  MISC_FEATURE: CD200
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 26 - protein, 325 aa, Homo sapiens [sequence omitted]

SEQ ID NO: 27 - protein, 201 aa, Homo sapiens
  MISC_FEATURE: NC R3 (NKp30)
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 28 - protein, 208 aa, Homo sapiens [sequence omitted]

SEQ ID NO: 29 - protein, 224 aa, Homo sapiens
  MISC_FEATURE: CD86(B7-2) ECD
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 30 - protein, 220 aa, Homo sapiens
  MISC_FEATURE: CD274 (PD-L1, B7-H1) ECD
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 31 - protein, 201 aa, Homo sapiens
  MISC_FEATURE: PDCD1LG2(PD-L2, CD273) ECD
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 32 - protein, 238 aa, Homo sapiens [sequence omitted]

SEQ ID NO: 33 - protein, 438 aa, Homo sapiens
  MISC_FEATURE: CD276(B7-H3) ECD
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEA

SEQ ID NO: 34 - protein, 235 aa, Homo sapiens
  MISC_FEATURE: VTCN1(B7-H4) ECD
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKAS

SEQ ID NO: 35 - protein, 134 aa, Homo sapiens
  MISC_FEATURE: CD28 ECD
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKP

SEQ ID NO: 36 - protein, 126 aa, Homo sapiens [sequence omitted]

SEQ ID NO: 37 - protein, 150 aa, Homo sapiens [sequence omitted]

SEQ ID NO: 38 - protein, 120 aa, Homo sapiens
  MISC_FEATURE: ICOS ECD
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLK

SEQ ID NO: 39 - protein, 127 aa, Homo sapiens
  MISC_FEATURE: BTLA(CD272) ECD
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYR

SEQ ID NO: 40 - protein, 371 aa, Homo sapiens
  MISC_FEATURE: CD4 ECD
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 41 - protein, 161 aa, Homo sapiens
  MISC_FEATURE: CD8A(CD8-alpha) ECD
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACD

SEQ ID NO: 42 - protein, 149 aa, Homo sapiens
  MISC_FEATURE: CD8B(CD8-beta) ECD
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSP

SEQ ID NO: 43 - protein, 422 aa, Homo sapiens
  MISC_FEATURE: LAG3 ECD
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHL

SEQ ID NO: 44 - protein, 181 aa, Homo sapiens
  MISC_FEATURE: HAVCR2(TIM-3) ECD
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIG

SEQ ID NO: 45 - protein, 394 aa, Homo sapiens
  MISC_FEATURE: CEACAM1 ECD
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPG

SEQ ID NO: 46 - protein, 120 aa, Homo sapiens
  MISC_FEATURE: TIGIT ECD
MMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIP

SEQ ID NO: 47 - protein, 323 aa, Homo sapiens
  MISC_FEATURE: PVR(CD155) ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 48 - protein, 329 aa, Homo sapiens
  MISC_FEATURE: PVRL2(CD112) ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 49 - protein, 236 aa, Homo sapiens [sequence omitted]

SEQ ID NO: 50 - protein, 185 aa, Homo sapiens
  MISC_FEATURE: CD2 ECD
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLD

SEQ ID NO: 51 - protein, 133 aa, Homo sapiens
  MISC_FEATURE: CD160 ECD
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLS

SEQ ID NO: 52 - protein, 202 aa, Homo sapiens
  MISC_FEATURE: CD200 ECD
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKG

SEQ ID NO: 53 - protein, 215 aa, Homo sapiens
  MISC_FEATURE: CD200R1(CD200R) ECD
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKL

SEQ ID NO: 54 - protein, 117 aa, Homo sapiens
  MISC_FEATURE: NC R3 (NKp30) ECD
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 55 - protein, 208 aa, Artificial Sequence
  CD80 v1 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 56 - protein, 208 aa, Artificial Sequence
  CD80 v2 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 57 - protein, 208 aa, Artificial Sequence
  CD80 v3 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEAPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 58 - protein, 208 aa, Artificial Sequence
  CD80 v4 ECD
VIHMTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 59 - protein, 208 aa, Artificial Sequence
  CD80 v5 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 60 - protein, 208 aa, Artificial Sequence
  CD80 v6 ECD
VIHVTKEVKEVATLSCGHNLSVEELAQTRIYWQKEKKMVLTMMSGDMNIWPEYKNRTIFDITNNLSIVIQALRPSDEGTYECVVLKYEKDSFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 61 - protein, 208 aa, Artificial Sequence
  CD80 v7 ECD
VIHVTKEVKEVATLSCGHNVSVEELAQTRIYWQKEKKMVLTMMPGDMNIWPEYKNRTIFDITNNLSIVIQALRPSDEGTYECVVLKYEKDGFKREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 62 - protein, 208 aa, Artificial Sequence
  CD80 v8 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFGIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 63 - protein, 208 aa, Artificial Sequence
  CD80 v9 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 64 - protein, 208 aa, Artificial Sequence
  CD80 v10 ECD
VIHVTKEVKEVATLSCGHNVSVEELAQTRIYWQKEKKMVLTMMSGDMNIWPEYKNRTIFDITNNLSIVIRALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 65 - protein, 208 aa, Artificial Sequence
  CD80 v11 ECD
VIHVTKEVKEVATLSCGHNVSVEELAQTRIYWQKEKKMVLTMMSGDMNIWPEYKNRTIFDITNNLSIVIQALRPSDEGTYACVVLKYEKDGFKREHLAEVTLSVKADFPTPSISDFEIPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 66 - protein, 208 aa, Artificial Sequence
  CD80 v12 ECD
VIHVTKEVKEVATLSCGHNVSVEELAQTRIYWQKEKKMVLTMMSGDMNIWPEYKNRTIFDITNNLSIVIQALRPSDEGTYECVVLKNEKDGFKREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 67 - protein, 208 aa, Artificial Sequence
  CD80 v13 ECD
VIHVTKEVKEVATLSCGHNVSVEELAQSRIYWQKEKKMVLTMMSGDMNIWPEYKNRTIFDITNNLSIVIQALRPSDEGTYECVVLKYEKDGFKRKHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 68 - protein, 208 aa, Artificial Sequence
  CD80 v14 ECD
VIHVTKEVKEVATLSCGHNVSVEELAQTRIYWQKEKKMVLTMMSGDMNIWPEYKNRTIFDITSNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 69 - protein, 208 aa, Artificial Sequence
  CD80 v15 ECD
VIHVTKEVKEVATLSCGHNVSVEELAQTRIYWQKEEKMVLTMMSGDMNIWPEYKNRTIFDITNNLSTVIQALRPSDEGTYECVVLKYEKDGFKREHLAEVTLSVKADFPTPSISDFEIPSSNIRRIICSASGGFPEPHLSWLENGEELNAITTTVSQDPETELYAVSSKLDFNMTTNHSFMCLIKYGHLRVNQTFNWNTTKQEHFPDN

SEQ ID NO: 70 - protein, 208 aa, Artificial Sequence
  CD80 v16 ECD
VIHVTKEVKEVATLSCGHNVSVEELAQTRIYWQKEKKMVLTMMSGDMNIWPGYKNRTIFDITNNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 71 - protein, 208 aa, Artificial Sequence
  CD80 v17 ECD
VIHVTKEVKEVATLSCGHNVSVEELAQTRIYWQKEKEMVLTMMSGDMNIWPEYKNRTISDITNNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 72 - protein, 208 aa, Artificial Sequence
  CD80 v18 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLPVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 73 - protein, 208 aa, Artificial Sequence
  CD80 v19 ECD
VIHVTKEVKEVATLSCGHNVSVEELAQTRIYWQKEKKMVLTMMSGDMNIWPEYKNRTIFDITNNLSIVILALRPSDEGTYECVVLKYEEDAFKREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 74 - protein, 208 aa, Artificial Sequence
  CD80 v20 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 75 - protein, 208 aa, Artificial Sequence
  CD80 v21 ECD
VIHVTKEVKEVATLSCGHNVSVEELAQTRIYWQKEKKMVLTMMSGDMNIWPEYKNRTIFVITNNLSIVILALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 76 - protein, 208 aa, Artificial Sequence
  CD80 v22 ECD
VIHVTKEVKEVATLSCGHNVSVEELAQTRIYWQKEKKMVLTMMSGDMNIWPEYMNRTIFDITNNLSIVILALRPSDEGTYECVVLKYEKDGFKREHLAEVTLSVKADFPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 77 - protein, 208 aa, Artificial Sequence
  CD80 v23 ECD
VIHVTKEVKEVATLSCGHNVSVEELAQTRIYWQKEKKTVLTMMSGDMNIWPEYKNRTIFDITNNLSIVIQALRPSDGGTYECVVLKYEKDGFKREHLAEVTLSVKADFPTPSISDFEIPSSNIRRIICSASGGFPEPHLSWLENGEELNAITTTVSQDPETELYAVSSKLDFNMTTNHSFMCLIKYGHLRVNQTFNWNTTKQEHFPDN

SEQ ID NO: 78 - protein, 208 aa, Artificial Sequence
  CD80 v24 ECD
VIHVTKEVKEVATLSCGHNVSVEELAQTHIYWQKEKKMVLTMMSGDMNIWPGYKNRTIFDITNNLSIVIRALRPSDEGTYECVVLKYGKDGFKREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 79 - protein, 208 aa, Artificial Sequence
  CD80 v25 ECD
VIHVTKEVKEVATLSCGHNVSVEELAQTRIHWQKEKKMVLGMMSGDMNIWPEYKNRTIFDITNNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 80 - protein, 208 aa, Artificial Sequence
  CD80 v26 ECD
VIHVTKEVKEVATLSCGHNVSVEELAQTRIYWQKEKKMVLTMMSGDMNIWPEYKNRTIFDITNNLSIAILALRPSDEGTYECVVLKYEKDAFKREHLAEVTLSVKADFPAPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 81 - protein, 208 aa, Artificial Sequence
  CD80 v27 ECD
VIHVTKEVKEVATLSCGHNVSVEELAQTRIYWQKEKKMVLTMMSGDMNIWPEYKNRTIFDITNNLHIVILALRPSDEGTYECVVLKYEKGAFKREHLAEVTLSVKADFPAPSISDLEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 82 - protein, 208 aa, Artificial Sequence
  CD80 v28 ECD
VIHVTKEVKEVATLSCGHNVSVEELAQTHIYWQKEKKMVLTMMSGDMNIWPGYKNRTIFDITNNLSIVILALRPSDEGTYECVVLKYEKDAFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 83 - protein, 208 aa, Artificial Sequence
  CD80 v29 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTSSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 84 - protein, 208 aa, Artificial Sequence
  CD80 v30 ECD
VIHVTKEVKEVATLSCGHNVSVEELAQTRIYWQKEKKMVLTMMSGDMNIWPEYKNRTIFDITNNLSTVIQALRPSDEGTYECVVLKYEKDGFKREHLAEVTLSVKADFPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 85 - protein, 208 aa, Artificial Sequence
  CD80 v31 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPAPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 86 - protein, 208 aa, Artificial Sequence
  CD80 v32 ECD
VIHVTKEVKEVATLSCGHNVSVEELAQTRIYWQKEKKVVLDMISGDMNIGPEYKNRTIFDITNNLSIVILALRPSGEGTYECAVLKYEEDAFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 87 - protein, 208 aa, Artificial Sequence
  CD80 v33 ECD
VIHVTKEVKEVATLSCGHNVSAEELAQTRIYWQKEKKMVLTMMSGDMNIWPEYKNRTIFDITNNLSIVIQALRPSDEGTYECVVLKYEKDAFKREHLAEVTLSVKADFPTPSISDFEIPTPNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 88 - protein, 208 aa, Artificial Sequence
  CD80 v34 ECD
VIHVTKEVKEVVTLFCGHNVSVEELAQTRIHWQKEKKMVLGMMSGDMNIWPEYKNRTIFDITNNLSIVILALRPSDEGTYECVVLKYEKDAFKREHLAEVTLSVKADFPTPSISDFEIPTSNIRRIICSASGGFPELHLSWLENGEELNAITTTVSQDPETELYAVSSKLDFNMTTNHSFMCLIKYGHLRVNQTFNWNTTKQEHFPDN

SEQ ID NO: 89 - protein, 208 aa, Artificial Sequence
  CD80 v35 ECD
VIHVTKEVKEVATLSCGHNVSVEELAQTRIYWQKEKKMVLTMMSGDMNIWPEYKNRTIFDITNNLSFVIRALRPSDEGTYECVVLKYGKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 90 - protein, 208 aa, Artificial Sequence
  CD80 v36 ECD
VIHVTKEVKEVATLSCGHNVSVEGPAQTRIYWQKEKKMVLTMMSGDMNIWPEYKNRTIFDITNNLSIVIQALRPSDEGTYECVVLKYEKDAFKREHLAEVTLSVKADFPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 91 - protein, 208 aa, Artificial Sequence
  CD80 v37 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGLKREHLAEVTLSVKADLPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 92 - protein, 208 aa, Artificial Sequence
  CD80 v38 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 93 - protein, 208 aa, Artificial Sequence
  CD80 v39 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPTSNIRRIICSTSGGFPEPHLSWLESGEELSAINTTVSQDPETELYAVSSKLDFNMTTNHSFMCLIKYGHLRVNQTFNWNTTKQEHFPDN

SEQ ID NO: 94 - protein, 208 aa, Artificial Sequence
  CD80 v40 ECD
VIHVTKEVKEVATLSCGHNVSVEELAQTDILWHKEGKIVLATRSGDTNIWPEYKNRTIFDITNNLSIVILALRPSDEGTYVCVVRKYENDTPVLEHLAEVTLSVKADFPTPSISDFEIPTSNIRRIICSTSGGFPEPHLSWLENGEESSAINTTVSQDPETELYAVSSKLDFNMTTNHSFMCLIKYGHLRVNQTFNWNTTKQEHFPDN

SEQ ID NO: 95 - protein, 208 aa, Artificial Sequence
  CD80 v41 ECD
VIHVTKEVKEVATLSCGHNVSVEGLAQTDILWHKEGKIVLAMRSGDTNIWPEYKNRTILDITNNLSIVILALRPSDEGTYVCVVRKYENDTPVLERLAEVTLSVKADFPTPSISDFEIPTSNIRRIICSTSGGFPEPHLSWLENGEELSAINTTVSQDPETELYAVSSKLDFNMTTNHSFMSLIKYGHLRVNQTFNWNTTKQEHFPDN

SEQ ID NO: 96 - protein, 208 aa, Artificial Sequence
  CD80 v42 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 97 - protein, 208 aa, Artificial Sequence
  CD80 v43 ECD
VIHVTKEVKEVATLSCGHNVSVEELAQTVIYWQKEKKMVLTMQSGDMNIWPEYKNRTIFDITNNLSIVILALRPSDEGTYRCVVIKYERLENQGEHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 98 - protein, 208 aa, Artificial Sequence
  CD80 v44 ECD
VIHVTKEVKEVATLSCGHNVSVEELAQTRIYWQKEKKMVLIMMSGDMNIWPEYKNRTIFDITNNLSIVILALRPSDEGTYECVVLKYEKDGFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 99 - protein, 208 aa, Artificial Sequence
  CD80 v45 ECD
VIHVTKEVKEVATLSCGHNVSVEELAQTRIYWQKEKKMVLTMMSGDMNIWPEYKNRTIFDITNNLSIVILALRPSDEGTYECVVLKYERKGYRREHLAEVTLSVKADFPTPSISDFEIPTSSIRRIICSTSGGFPEPHLSWLENGEELNAINTTVSQDPETELYAVSSKLDFNMTTSHSFMCLIKYGHLRVNQTFNWNTTKQEHFPDN

SEQ ID NO: 100 - protein, 208 aa, Artificial Sequence
  CD80 v46 ECD
VIHVTKEVKEVATLSCGHNVSVEELAQTRIYWQKEKKMVLTMMSGDMNIWPEYKNRTIFDITNNLSIVILALRPSDEGTYECVVLKYERKGYRREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 101 - protein, 208 aa, Artificial Sequence
  CD80 v47 ECD
VIHVTKEVKEVATLSCGHNVSVEELAQTRIYWQKEGQIVLTMMSGDMNIWPEYKNRTILDITNNLSIVILALRPSDEGTYVCVVRKYENDTPVLEHLAGVTLSVKADFPTPSISDFEIPTSNIRRIICSASGGFPEPHLSWLENGEELSAINTTVSQDPETELYAVSSKLDFNMTTNHSFMCLIKYGHLRVNQTFNWNTTKQEHFPDN

SEQ ID NO: 102 - protein, 208 aa, Artificial Sequence
  CD80 v48 ECD
VIHVTKEVKEVATLSCGHNVSVEELAQTRIYWQKEKKMVLTMMSGDMNIWPEYKNRTIFDITNNLSIVILALRPSDEGTYECVVLKYDRKGYRREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 103 - protein, 208 aa, Artificial Sequence
  CD80 v49 ECD
VIHVTKEVKEVATLSCGHNVSVEELAQTRIYWQKEGQIVMTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 104 - protein, 208 aa, Artificial Sequence
  CD80 v50 ECD
VIHVTKEVKEVATLSCGHNVSVEELAQTRIYWQKEGKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 105 - protein, 208 aa, Artificial Sequence
  CD80 v51 ECD
VIHVTKEVKEVATLSCGHNVSVEELAQTHIHWQKEKKMVLGMMSGDMNIWPEYKNRTIFDITNNLSIVILALRPSDEGTYECVVLKNGENGFKREHLAEVTLSVKADFSTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 106 - protein, 208 aa, Artificial Sequence
  CD80 v52 ECD
VIHVTKEVKEVTTLSCGLNVSVEELAQTRIYWQKEKKMVLTMVSGDMNIWPEYKNRTILDITNNLSIVILALRPSDKGTYECVVLKYEKDAFKREHLAEVTLSVKADFSTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 107 - protein, 208 aa, Artificial Sequence
  CD80 v53 ECD
VIHVTKEVKEVATLSCGHNVSVEELAQTVIFWQKEGKLVLTMQSGDMNIWPEYKNRTIFDITNNLSIVILALRPSDEGTYRCIVIKYERLENQGEHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 108 - protein, 208 aa, Artificial Sequence
  CD80 v54 ECD
VIHVTKEVKEVATLSCGHNVSVEELAQTRIYWQKEKKMVLTMMSGDMNIWPEYKNRTIFDITNNLSIMIPAPRPSDEGTYECVVLEYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 109 - protein, 238 aa, Artificial Sequence
  ICOSL v1 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 110 - protein, 238 aa, Artificial Sequence
  ICOSL v2 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 111 - protein, 238 aa, Artificial Sequence
  ICOSL v3 ECD
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 112 - protein, 238 aa, Artificial Sequence
  ICOSL v4 ECD
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSQSLGFQEVLSVEVTLHVAANFSVPVVSAPHSPSQDELTLTCTSINGYPRPNVYWINKTDNSLLDQALQNDTVFLNMRGLYDVVSVLRIARTPSVNIGCCIENVPLQQNLTVGSQTGNDIGERDKITENPVSTGEKNAAT

SEQ ID NO: 113 - protein, 238 aa, Artificial Sequence
  ICOSL v5 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 114 - protein, 238 aa, Artificial Sequence
  ICOSL v6 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGCPRPNVCWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 115 - protein, 238 aa, Artificial Sequence
  ICOSL v7 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 116 - protein, 238 aa, Artificial Sequence
  ICOSL v8 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTDTSINGYPRPNVYWINKTDNSLLDQALQNDTVFLNMRGLYDVVSVLRIARTPSVNIGCCIENVLLQQNLTVGSQTGNDIGERDKIAENPVSTGEKNAAT

SEQ ID NO: 117 - protein, 238 aa, Artificial Sequence
  ICOSL v9 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKIAENPVSTGEKNAAT

SEQ ID NO: 118 - protein, 238 aa, Artificial Sequence
  ICOSL v10 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQRFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 119 - protein, 238 aa, Artificial Sequence
  ICOSL v11 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLGQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 120 - protein, 238 aa, Artificial Sequence
  ICOSL v12 ECD
DTQEKEVRAMVGSDVELSCACPEGSRFDLNDVYVYWQTSESKTVVTYHIPQYSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 121 - protein, 238 aa, Artificial Sequence
  ICOSL v13 ECD
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 122 - protein, 238 aa, Artificial Sequence
  ICOSL v14 ECD
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 123 - protein, 238 aa, Artificial Sequence
  ICOSL v15 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHGPSQDELTFTCTSINGYPRPNVCWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 124 - protein, 238 aa, Artificial Sequence
  ICOSL v16 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVCWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 125 - protein, 238 aa, Artificial Sequence
  ICOSL v17 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 126 - protein, 238 aa, Artificial Sequence
  ICOSL v18 ECD
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVCWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 127 - protein, 238 aa, Artificial Sequence
  ICOSL v19 ECD
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSQSLGFQEVLSVEVTLHVAANFSVPVVSAPPSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 128 - protein, 238 aa, Artificial Sequence
  ICOSL v20 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSPLDQALQNDTVFLNMRGLYDVVSVLRIARTPSVNIGCRIENVLLQQNLTVGSQTGNDIGERDKITENPVSTGEKNAAT

SEQ ID NO: 129 - protein, 238 aa, Artificial Sequence
  ICOSL v21 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVELHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 130 - protein, 238 aa, Artificial Sequence
  ICOSL v22 ECD
DTQEKEVRAMVGSDVELSCACPEGSRFDLNDVYVYWQTSESKTVVTYHIPQNSALENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 131 - protein, 238 aa, Artificial Sequence
  ICOSL v23 ECD
DTQEKEVRAMVGSDVELSCACPEGSRFDLNDVYVYWQTSESKTVVTYHIPQDSPLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 132 - protein, 238 aa, Artificial Sequence
  ICOSL v24 ECD
DTQEKEVRAMVGSDVELSCACPEGSRFDLNDVYVYWQTSESKTVVTYHIPQKSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNPTVGSQTGNDIGERDKITENPVSTGEKNAAT

SEQ ID NO: 133 - protein, 238 aa, Artificial Sequence
  ICOSL v25 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVHWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 134 - protein, 238 aa, Artificial Sequence
  ICOSL v26 ECD
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNAYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 135 - protein, 238 aa, Artificial Sequence
  ICOSL v27 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSTNGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 136 - protein, 238 aa, Artificial Sequence
  ICOSL v28 ECD
DTQEKEVRAMVGSDVELSCACPEGSRFDLNDVYVYWQTSESKTVVTYHIPQSSSLENVDSRYRNRALMSPAGMLRGDFSPRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 137 - protein, 238 aa, Artificial Sequence
  ICOSL v29 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANSSVPVVSAPHSPSQDELTFTCTSINGYPRPNVHWINKTDNSLLDQALQNDTVFLNMRGLYDVVSVLRIARTPSVNIGCCIESVLLQQNLTVGSQTGNDIGERDKITENPVSTGEKNAAT

SEQ ID NO: 138 - protein, 238 aa, Artificial Sequence
  ICOSL v30 ECD
DTQEKEVRAMVGSDVELSCACPEGSRFDLNDVYVYWQTSESKTVVTYHIPQSSSLENVDSRYRNRALMSPAGMLQGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVPLQQNLTVGSQTGNDIGERDKITENPVSTGEKNAAT

SEQ ID NO: 139 - protein, 238 aa, Artificial Sequence
  ICOSL v31 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTGNSLLDQALQNDTVFLNMRGLYDVVSVLRIARTPSVNIGCCIENVLLQQNLTVGSQTGNDIGERDKITENPVSTGEKNAAT

SEQ ID NO: 140 - protein, 238 aa, Artificial Sequence
  ICOSL v32 ECD
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVPVVSAPHSPSHDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 141 - protein, 238 aa, Artificial Sequence
  ICOSL v33 ECD
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 142 - protein, 238 aa, Artificial Sequence
  ICOSL v34 ECD
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLEFQEVLSVEVTLHVAANSSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 143 - protein, 117 aa, Artificial Sequence
  NKp30 v1 ECD
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLG

SEQ ID NO: 144 - protein, 117 aa, Artificial Sequence
  NKp30 v2 ECD
LWVSQPPEIRTLEGSSAFLPCSFNASQGRVAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 145 - protein, 117 aa, Artificial Sequence
  NKp30 v3 ECD
LWVSQPPEIRTLEGSSAFLPCSFNASQGRLAIGSVTWFRDEVVPGKEVRNGTPEFRGRLVPLASSRFLHDHQAELHIRDVRGHDASIYVCRVEVLGLGVGTGNGTRLVVEKEHPQLG

SEQ ID NO: 146 - protein, 117 aa, Artificial Sequence
  NKp30 v4 ECD
LWVSQPPEIRTLEGSSAFLPCSFNASQGRLAIGSVTWFRDEVVPGKEVRNGTPEFRGRLAPLAPSRFLHDHQAELHIRDVRGHDASIYVCRVEVLGLGVGTGNGTRLVVEKEHPQLG

SEQ ID NO: 147 - protein, 117 aa, Artificial Sequence
  NKp30 v5 ECD
LWVSQPPEIRTLEGSSAFLPCSFNASQGRLAIGSVTWFRDEVVPGKEVRNGTPEFRGRLAPLASSRFLHDHQAELHIRDVRGHDAGIYVCRVEVLGLGVGTGNGTRLVVEKEHPQLG

SEQ ID NO: 148 - protein, 224 aa, Artificial Sequence
  CD86 v1 ECD
APLKIQAYFNETADLPCQFANSQNQSLSELVVFWHDQENLVLNEVYLGKEKFDSVHSKYMGRTSFDSDSWTLRLHNLQIKDKGLYQCIILHKKPTGMIRIHHMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 149 - protein, 224 aa, Artificial Sequence
  CD86 v2 ECD
APLKIQAYFNETADLPCQFANSQNQSLSELVVFWHDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 150 - protein, 224 aa, Artificial Sequence
  CD86 v3 ECD
APLKIQAYFNETADLPCQFANSQNQSLSELVVFWQDQENLVLNEVYLGKEKFDSVHSKYMGRTSFDSDSWTLRLHNLQIKDKGLYQCIILHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 151 - protein, 224 aa, Artificial Sequence
  CD86 v4 ECD
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHHMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 152 - protein, 101 aa, Artificial Sequence
  CD80 WT IgV
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVT

SEQ ID NO: 153 - protein, 101 aa, Artificial Sequence
  CD80 v1 IgV
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVT

SEQ ID NO: 154 - protein, 101 aa, Artificial Sequence
  CD80 v20 IgV
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVT

SEQ ID NO: 155 - protein, 101 aa, Artificial Sequence
  CD80 v6 IgV
VIHVTKEVKEVATLSCGHNLSVEELAQTRIYWQKEKKMVLTMMSGDMNIWPEYKNRTIFDITNNLSIVIQALRPSDEGTYECVVLKYEKDSFKREHLAEVT

SEQ ID NO: 156 - protein, 101 aa, Artificial Sequence
  CD80 v7 IgV
VIHVTKEVKEVATLSCGHNVSVEELAQTRIYWQKEKKMVLTMMPGDMNIWPEYKNRTIFDITNNLSIVIQALRPSDEGTYECVVLKYEKDGFKREHLAEVT

SEQ ID NO: 157 - protein, 101 aa, Artificial Sequence; identical to SEQ ID NO: 154
  CD80 v9 IgV

SEQ ID NO: 158 - protein, 101 aa, Artificial Sequence
  CD80 v10 IgV
VIHVTKEVKEVATLSCGHNVSVEELAQTRIYWQKEKKMVLTMMSGDMNIWPEYKNRTIFDITNNLSIVIRALRPSDEGTYECVVLKYEKDGFKREHLAEVT

SEQ ID NO: 159 - protein, 101 aa, Artificial Sequence
  CD80 v11 IgV
VIHVTKEVKEVATLSCGHNVSVEELAQTRIYWQKEKKMVLTMMSGDMNIWPEYKNRTIFDITNNLSIVIQALRPSDEGTYACVVLKYEKDGFKREHLAEVT

SEQ ID NO: 160 - protein, 101 aa, Artificial Sequence
  CD80 v12 IgV
VIHVTKEVKEVATLSCGHNVSVEELAQTRIYWQKEKKMVLTMMSGDMNIWPEYKNRTIFDITNNLSIVIQALRPSDEGTYECVVLKNEKDGFKREHLAEVT

SEQ ID NO: 161 - protein, 101 aa, Artificial Sequence
  CD80 v13 IgV
VIHVTKEVKEVATLSCGHNVSVEELAQSRIYWQKEKKMVLTMMSGDMNIWPEYKNRTIFDITNNLSIVIQALRPSDEGTYECVVLKYEKDGFKRKHLAEVT

SEQ ID NO: 162 - protein, 101 aa, Artificial Sequence
  CD80 v14 IgV
VIHVTKEVKEVATLSCGHNVSVEELAQTRIYWQKEKKMVLTMMSGDMNIWPEYKNRTIFDITSNLSIVIQALRPSDEGTYECVVLKYEKDGFKREHLAEVT

SEQ ID NO: 163 - protein, 101 aa, Artificial Sequence
  CD80 v15 IgV
VIHVTKEVKEVATLSCGHNVSVEELAQTRIYWQKEEKMVLTMMSGDMNIWPEYKNRTIFDITNNLSTVIQALRPSDEGTYECVVLKYEKDGFKREHLAEVT

SEQ ID NO: 164 - protein, 101 aa, Artificial Sequence
  CD80 v16 IgV
VIHVTKEVKEVATLSCGHNVSVEELAQTRIYWQKEKKMVLTMMSGDMNIWPGYKNRTIFDITNNLSIVIQALRPSDEGTYECVVLKYEKDGFKREHLAEVT

SEQ ID NO: 165 - protein, 101 aa, Artificial Sequence
  CD80 v17 IgV
VIHVTKEVKEVATLSCGHNVSVEELAQTRIYWQKEKEMVLTMMSGDMNIWPEYKNRTISDITNNLSIVIQALRPSDEGTYECVVLKYEKDGFKREHLAEVT

SEQ ID NO: 166 - protein, 101 aa, Artificial Sequence
  CD80 v19 IgV
VIHVTKEVKEVATLSCGHNVSVEELAQTRIYWQKEKKMVLTMMSGDMNIWPEYKNRTIFDITNNLSIVILALRPSDEGTYECVVLKYEEDAFKREHLAEVT

SEQ ID NO: 167 - protein, 101 aa, Artificial Sequence
  CD80 v21 IgV
VIHVTKEVKEVATLSCGHNVSVEELAQTRIYWQKEKKMVLTMMSGDMNIWPEYKNRTIFVITNNLSIVILALRPSDEGTYECVVLKYEKDGFKREHLAEVT

SEQ ID NO: 168 - protein, 101 aa, Artificial Sequence
  CD80 v22 IgV
VIHVTKEVKEVATLSCGHNVSVEELAQTRIYWQKEKKMVLTMMSGDMNIWPEYMNRTIFDITNNLSIVILALRPSDEGTYECVVLKYEKDGFKREHLAEVT

SEQ ID NO: 169 - protein, 101 aa, Artificial Sequence
  CD80 v23 IgV
VIHVTKEVKEVATLSCGHNVSVEELAQTRIYWQKEKKTVLTMMSGDMNIWPEYKNRTIFDITNNLSIVIQALRPSDGGTYECVVLKYEKDGFKREHLAEVT

SEQ ID NO: 170 - protein, 101 aa, Artificial Sequence
  CD80 v24 IgV
VIHVTKEVKEVATLSCGHNVSVEELAQTHIYWQKEKKMVLTMMSGDMNIWPGYKNRTIFDITNNLSIVIRALRPSDEGTYECVVLKYGKDGFKREHLAEVT

SEQ ID NO: 171 - protein, 101 aa, Artificial Sequence
  CD80 v25 IgV
VIHVTKEVKEVATLSCGHNVSVEELAQTRIHWQKEKKMVLGMMSGDMNIWPEYKNRTIFDITNNLSIVIQALRPSDEGTYECVVLKYEKDGFKREHLAEVT

SEQ ID NO: 172 - protein, 101 aa, Artificial Sequence
  CD80 v26 IgV
VIHVTKEVKEVATLSCGHNVSVEELAQTRIYWQKEKKMVLTMMSGDMNIWPEYKNRTIFDITNNLSIAILALRPSDEGTYECVVLKYEKDAFKREHLAEVT

SEQ ID NO: 173 - protein, 101 aa, Artificial Sequence
  CD80 v27 IgV
VIHVTKEVKEVATLSCGHNVSVEELAQTRIYWQKEKKMVLTMMSGDMNIWPEYKNRTIFDITNNLHIVILALRPSDEGTYECVVLKYEKGAFKREHLAEVT

SEQ ID NO: 174 - protein, 101 aa, Artificial Sequence
  CD80 v28 IgV
VIHVTKEVKEVATLSCGHNVSVEELAQTHIYWQKEKKMVLTMMSGDMNIWPGYKNRTIFDITNNLSIVILALRPSDEGTYECVVLKYEKDAFKREHLAEVT

SEQ ID NO: 175 - protein, 101 aa, Artificial Sequence
  CD80 v30 IgV
VIHVTKEVKEVATLSCGHNVSVEELAQTRIYWQKEKKMVLTMMSGDMNIWPEYKNRTIFDITNNLSTVIQALRPSDEGTYECVVLKYEKDGFKREHLAEVT

SEQ ID NO: 176 - protein, 101 aa, Artificial Sequence
  CD80 v32 IgV
VIHVTKEVKEVATLSCGHNVSVEELAQTRIYWQKEKKVVLDMISGDMNIGPEYKNRTIFDITNNLSIVILALRPSGEGTYECAVLKYEEDAFKREHLAEVT

SEQ ID NO: 177 - protein, 101 aa, Artificial Sequence
  CD80 v33 IgV
VIHVTKEVKEVATLSCGHNVSAEELAQTRIYWQKEKKMVLTMMSGDMNIWPEYKNRTIFDITNNLSIVIQALRPSDEGTYECVVLKYEKDAFKREHLAEVT

SEQ ID NO: 178 - protein, 101 aa, Artificial Sequence
  CD80 v34 IgV
VIHVTKEVKEVVTLFCGHNVSVEELAQTRIHWQKEKKMVLGMMSGDMNIWPEYKNRTIFDITNNLSIVILALRPSDEGTYECVVLKYEKDAFKREHLAEVT

SEQ ID NO: 179 - protein, 101 aa, Artificial Sequence
  CD80 v35 IgV
VIHVTKEVKEVATLSCGHNVSVEELAQTRIYWQKEKKMVLTMMSGDMNIWPEYKNRTIFDITNNLSFVIRALRPSDEGTYECVVLKYGKDGFKREHLAEVT

SEQ ID NO: 180 - protein, 101 aa, Artificial Sequence
  CD80 v36 IgV
VIHVTKEVKEVATLSCGHNVSVEGPAQTRIYWQKEKKMVLTMMSGDMNIWPEYKNRTIFDITNNLSIVIQALRPSDEGTYECVVLKYEKDAFKREHLAEVT

SEQ ID NO: 181 - protein, 101 aa, Artificial Sequence
  CD80 v37 IgV
VIHVTKEVKEVATLSCGHNVSVEELAQTRIYWQKEKKMVLTMMSGDMNIWPEYKNRTIFDITNNLSIVILALRPSDEGTYECVVLKYEKDGLKREHLAEVT

SEQ ID NO: 182 - protein, 101 aa, Artificial Sequence
  CD80 v38 IgV
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVT

SEQ ID NO: 183 - protein, 101 aa, Artificial Sequence
  CD80 v40 IgV
VIHVTKEVKEVATLSCGHNVSVEELAQTDILWHKEGKIVLATRSGDTNIWPEYKNRTIFDITNNLSIVILALRPSDEGTYVCVVRKYENDTPVLEHLAEVT

SEQ ID NO: 184 - protein, 101 aa, Artificial Sequence
  CD80 v41 IgV
VIHVTKEVKEVATLSCGHNVSVEGLAQTDILWHKEGKIVLAMRSGDTNIWPEYKNRTILDITNNLSIVILALRPSDEGTYVCVVRKYENDTPVLERLAEVT

SEQ ID NO: 185 - protein, 101 aa, Artificial Sequence
  CD80 v43 IgV
VIHVTKEVKEVATLSCGHNVSVEELAQTVIYWQKEKKMVLTMQSGDMNIWPEYKNRTIFDITNNLSIVILALRPSDEGTYRCVVIKYERLENQGEHLAEVT

SEQ ID NO: 186 - protein, 101 aa, Artificial Sequence
  CD80 v44 IgV
VIHVTKEVKEVATLSCGHNVSVEELAQTRIYWQKEKKMVLIMMSGDMNIWPEYKNRTIFDITNNLSIVILALRPSDEGTYECVVLKYEKDGFKREHLAEVT

SEQ ID NO: 187 - protein, 101 aa, Artificial Sequence
  CD80 v45 IgV
VIHVTKEVKEVATLSCGHNVSVEELAQTRIYWQKEKKMVLTMMSGDMNIWPEYKNRTIFDITNNLSIVILALRPSDEGTYECVVLKYERKGYRREHLAEVT

SEQ ID NO: 188 - protein, 101 aa, Artificial Sequence
  CD80 v47 IgV
VIHVTKEVKEVATLSCGHNVSVEELAQTRIYWQKEGQIVLTMMSGDMNIWPEYKNRTILDITNNLSIVILALRPSDEGTYVCVVRKYENDTPVLEHLAGVT

SEQ ID NO: 189 - protein, 101 aa, Artificial Sequence
  CD80 v48 IgV
VIHVTKEVKEVATLSCGHNVSVEELAQTRIYWQKEKKMVLTMMSGDMNIWPEYKNRTIFDITNNLSIVILALRPSDEGTYECVVLKYDRKGYRREHLAEVT

SEQ ID NO: 190 - protein, 101 aa, Artificial Sequence
  CD80 v49 IgV
VIHVTKEVKEVATLSCGHNVSVEELAQTRIYWQKEGQIVMTMMSGDMNIWPEYKNRTIFDITNNLSIVILALRPSDEGTYECVVLKYEKDAFKREHLAEVT

SEQ ID NO: 191 - protein, 101 aa, Artificial Sequence
  CD80 v50 IgV
VIHVTKEVKEVATLSCGHNVSVEELAQTRIYWQKEGKMVLTMMSGDMNIWPEYKNRTIFDITNNLSIVILALRPSDEGTYECVVLKYEKDAFKREHLAEVT

SEQ ID NO: 192 - protein, 101 aa, Artificial Sequence
  CD80 v51 IgV
VIHVTKEVKEVATLSCGHNVSVEELAQTHIHWQKEKKMVLGMMSGDMNIWPEYKNRTIFDITNNLSIVILALRPSDEGTYECVVLKNGENGFKREHLAEVT

SEQ ID NO: 193 - protein, 101 aa, Artificial Sequence
  CD80 v52 IgV
VIHVTKEVKEVTTLSCGLNVSVEELAQTRIYWQKEKKMVLTMVSGDMNIWPEYKNRTILDITNNLSIVILALRPSDKGTYECVVLKYEKDAFKREHLAEVT

SEQ ID NO: 194 - protein, 101 aa, Artificial Sequence
  CD80 v53 IgV
VIHVTKEVKEVATLSCGHNVSVEELAQTVIFWQKEGKLVLTMQSGDMNIWPEYKNRTIFDITNNLSIVILALRPSDEGTYRCIVIKYERLENQGEHLAEVT

SEQ ID NO: 195 - protein, 101 aa, Artificial Sequence
  CD80 v54 IgV
VIHVTKEVKEVATLSCGHNVSVEELAQTRIYWQKEKKMVLTMMSGDMNIWPEYKNRTIFDITNNLSIMIPAPRPSDEGTYECVVLEYEKDAFKREHLAEVT

SEQ ID NO: 196 - protein, 111 aa, Artificial Sequence
  ICOSL WT IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVE

SEQ ID NO: 197 - protein, 111 aa, Artificial Sequence
  ICOSL v1 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVE

SEQ ID NO: 198 - protein, 111 aa, Artificial Sequence
  ICOSL v2 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVE

SEQ ID NO: 199 - protein, 111 aa, Artificial Sequence
  ICOSL v3 IgV
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVE

SEQ ID NO: 200 - protein, 111 aa, Artificial Sequence
  ICOSL v4 IgV
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSQSLGFQEVLSVE

SEQ ID NO: 201 - protein, 111 aa, Artificial Sequence
  ICOSL v5 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVE

SEQ ID NO: 202 - protein, 111 aa, Artificial Sequence
  ICOSL v10 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQRFHCLVLSQSLGFQEVLSVE

SEQ ID NO: 203 - protein, 111 aa, Artificial Sequence
  ICOSL v11 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLGQSLGFQEVLSVE

SEQ ID NO: 204 - protein, 111 aa, Artificial Sequence
  ICOSL v12 IgV
DTQEKEVRAMVGSDVELSCACPEGSRFDLNDVYVYWQTSESKTVVTYHIPQYSSLENVDSRYRNRALMSPAGMLRGDFSLRLFNVTPQDEQKFHCLVLSQSLGFQEVLSVE

SEQ ID NO: 205 - protein, 111 aa, Artificial Sequence
  ICOSL v13 IgV
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSQSLGFQEVLSVE

SEQ ID NO: 206 - protein, 111 aa, Artificial Sequence
  ICOSL v14 IgV
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSPSLGFQEVLSVE

SEQ ID NO: 207 - protein, 111 aa, Artificial Sequence
  ICOSL v22 IgV
DTQEKEVRAMVGSDVELSCACPEGSRFDLNDVYVYWQTSESKTVVTYHIPQNSALENVDSRYRNRALMSPAGMLRGDFSLRLFNVTPQDEQKFHCLVLSQSLGFQEVLSVE

SEQ ID NO: 208 - protein, 111 aa, Artificial Sequence
  ICOSL v23 IgV
DTQEKEVRAMVGSDVELSCACPEGSRFDLNDVYVYWQTSESKTVVTYHIPQDSPLENVDSRYRNRALMSPAGMLRGDFSLRLFNVTPQDEQKFHCLVLSQSLGFQEVLSVE

SEQ ID NO: 209 - protein, 111 aa, Artificial Sequence
  ICOSL v24 IgV
DTQEKEVRAMVGSDVELSCACPEGSRFDLNDVYVYWQTSESKTVVTYHIPQKSSLENVDSRYRNRALMSPAGMLRGDFSLRLFNVTPQDEQKFHCLVLSQSLGFQEVLSVE

SEQ ID NO: 210 - protein, 111 aa, Artificial Sequence
  ICOSL v28 IgV
DTQEKEVRAMVGSDVELSCACPEGSRFDLNDVYVYWQTSESKTVVTYHIPQSSSLENVDSRYRNRALMSPAGMLRGDFSPRLFNVTPQDEQKFHCLVLSQSLGFQEVLSVE

SEQ ID NO: 211 - protein, 111 aa, Artificial Sequence
  ICOSL v30 IgV
DTQEKEVRAMVGSDVELSCACPEGSRFDLNDVYVYWQTSESKTVVTYHIPQSSSLENVDSRYRNRALMSPAGMLQGDFSLRLFNVTPQDEQKFHCLVLSQSLGFQEVLSVE

SEQ ID NO: 212 - protein, 111 aa, Artificial Sequence
  ICOSL v33 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLGFQEVLSVE

SEQ ID NO: 213 - protein, 111 aa, Artificial Sequence
  ICOSL v34 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLEFQEVLSVE

SEQ ID NO: 214 - protein, 108 aa, Homo sapiens
  MISC_FEATURE: NKp30 WT IgC-like
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLV

SEQ ID NO: 215 - protein, 108 aa, Artificial Sequence
  NKp30 v1 IgC-like
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLV

SEQ ID NO: 216 - protein, 108 aa, Artificial Sequence
  NKp30 v2 IgC-like
LWVSQPPEIRTLEGSSAFLPCSFNASQGRVAIGSVTWFRDEVVPGKEVRNGTPEFRGRLAPLASSRFLHDHQAELHIRDVRGHDASIYVCRVEVLGLGVGTGNGTRLV

SEQ ID NO: 217 - protein, 108 aa, Artificial Sequence
  NKp30 v3 IgC-like
LWVSQPPEIRTLEGSSAFLPCSFNASQGRLAIGSVTWFRDEVVPGKEVRNGTPEFRGRLVPLASSRFLHDHQAELHIRDVRGHDASIYVCRVEVLGLGVGTGNGTRLV

SEQ ID NO: 218 - protein, 108 aa, Artificial Sequence
  NKp30 v4 IgC-like
LWVSQPPEIRTLEGSSAFLPCSFNASQGRLAIGSVTWFRDEVVPGKEVRNGTPEFRGRLAPLAPSRFLHDHQAELHIRDVRGHDASIYVCRVEVLGLGVGTGNGTRLV

SEQ ID NO: 219 - protein, 108 aa, Artificial Sequence
  NKp30 v5 IgC-like
LWVSQPPEIRTLEGSSAFLPCSFNASQGRLAIGSVTWFRDEVVPGKEVRNGTPEFRGRLAPLASSRFLHDHQAELHIRDVRGHDAGIYVCRVEVLGLGVGTGNGTRLV

SEQ ID NO: 220 - protein, 99 aa, Homo sapiens
  MISC_FEATURE: CD86 WT IgV
NETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELS

SEQ ID NO: 221 - protein, 99 aa, Artificial Sequence
  CD86 v1 IgV
NETADLPCQFANSQNQSLSELVVFWHDQENLVLNEVYLGKEKFDSVHSKYMGRTSFDSDSWTLRLHNLQIKDKGLYQCIILHKKPTGMIRIHHMNSELS

SEQ ID NO: 222 - protein, 99 aa, Artificial Sequence
  CD86 v2 IgV
NETADLPCQFANSQNQSLSELVVFWHDQENLVLNEVYLGKEKFDSVHSKYMGRTSFDSDSWTLRLHNLQIKDKGLYQCIIHHKKPTGMIRIHQMNSELS

SEQ ID NO: 223 - protein, 99 aa, Artificial Sequence
  CD86 v3 IgV
NETADLPCQFANSQNQSLSELVVFWQDQENLVLNEVYLGKEKFDSVHSKYMGRTSFDSDSWTLRLHNLQIKDKGLYQCIILHKKPTGMIRIHQMNSELS

SEQ ID NO: 224 - protein, 99 aa, Artificial Sequence
  CD86 v4 IgV
NETADLPCQFANSQNQSLSELVVFWQDQENLVLNEVYLGKEKFDSVHSKYMGRTSFDSDSWTLRLHNLQIKDKGLYQCIIHHKKPTGMIRIHHMNSELS

SEQ ID NO: 225 - protein, 19 aa, Homo sapiens
  MISC_FEATURE: VH signal peptide
MGSTAILALLLAVLQGVSA

SEQ ID NO: 226 - protein, 232 aa, Homo sapiens
  MISC_FEATURE: IgG1 Fc
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 227 - protein, 235 aa, Homo sapiens
  MISC_FEATURE: IgG2 Fc
TKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 228 - protein, 15 aa, Artificial Sequence
  IgV-IgV linker
GGGGSGGGGSGGGGS

SEQ ID NO: 229 - protein, 10 aa, Artificial Sequence
  IgV-Fc linker 1
GGGGSGGGGS

SEQ ID NO: 230 - protein, 13 aa, Artificial Sequence
  IgV-Fc linker 2
GGGGSGGGGSAAA

SEQ ID NO: 231 - protein, 15 aa, Artificial Sequence
  CD80 WT linker 1
KADFPTPSISDFEIP

SEQ ID NO: 232 - protein, 10 aa, Artificial Sequence
  CD80 WT linker 2
TTKQEHFPDN

SEQ ID NO: 233 - protein, 11 aa, Artificial Sequence
  ICOSL WT linker 1
VTLHVAANFSV

SEQ ID NO: 234 - protein, 29 aa, Artificial Sequence
  ICOSL WT linker 2
VGSQTGNDIGERDKITENPVSTGEKNAAT

SEQ ID NO: 235 - protein, 9 aa, Artificial Sequence
  NKp30 WT linker 1
VEKEHPQLG

SEQ ID NO: 236 - protein, 9 aa, Artificial Sequence
  CD86 WT linker 1
APLKIQAYF

SEQ ID NO: 237 - protein, 18 aa, Artificial Sequence
  CD86 WT linker 2
VLANFSQPEIVPISNITE

SEQ ID NO: 238 - protein, 22 aa, Artificial Sequence
  CD86 WT linker 3
RLLSSPFSIELEDPQPPPDHIP

SEQ ID NO: 239 - protein, 238 aa, Artificial Sequence
  ICOSL v35 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLEFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 240 - protein, 111 aa, Artificial Sequence
  ICOSL v35 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLEFQEVLSVE

SEQ ID NO: 241 - protein, 254 aa, Artificial Sequence
  CD80-TIP I67T/L70Q/A91G/T120S
VIHVTKEVKEVATLSCGHNVSVEELAQTRIYWQKEKKMVLTMMSGDMNIWPEYKNRTIFDITNNLSTVIQALRPSDEGTYECVVLKYEKDGFKREHLAEVTLSVKADFPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 242 - DNA, 867 bp, Artificial Sequence
  CD80-TIP I67T/L70Q/A91G/T120S
atgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccacagtgatccaagctctgcgcccatctgacgagggcacatacgagtgtgttgttctgaagtatgaaaaagacggcttcaagcgggaacacctggctgaagtgacgttatcagtcaaagctgacttccctacacctagtatatctgactttgaaattccatcttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataa

SEQ ID NO: 243 - protein, 284 aa, Artificial Sequence
  ICOSL-TIP N52H/I143T
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSTNGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 244 - DNA, 909 bp, Artificial Sequence
  ICOSL-TIP N52H/I143T
atgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccaccaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttga

SEQ ID NO: 245 - protein, 248 aa, Artificial Sequence
  Anti-CD19 scFv
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAA

SEQ ID NO: 246 - protein, 71 aa, Artificial Sequence
  CD8-derived hinge and transmembrane domain
KPTTTPAPRPPTPAPTIASQPLSLRPEASRPAAGGAVHTRGLDFASDIYIWAPLAGTCGVLLLSLVITLYC

SEQ ID NO: 247 - protein, 112 aa, Artificial Sequence
  CD3zeta intracellular signaling domain
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 248 - DNA, 1356 bp, Artificial Sequence
  AntiCD19x8z chimeric antigen receptor
  misc_feature: antiCD19x8z chimeric antigen receptor nucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggactaagttggaaataacaggctccacctctggatccggcaagcccggatctggcgagggatccaccaagggcgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcagcggccgcaaagcccaccacgacgccagcgccgcgaccaccaacaccggcgcccaccatcgcgtcgcagcccctgtccctgcgcccagaggcgagccggccagcggcggggggcgcagtgcacacgagggggctggacttcgccagtgatatctacatctgggcgcccctggccgggacttgtggggtccttctcctgtcactggttatcaccctttactgcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 249 - DNA, 63 bp, Artificial Sequence
  T2A
ggcagtggcgagggcagaggaagtctgctaacatgcggtgacgtcgaggagaatcctggccca

SEQ ID NO: 250 - protein, 21 aa, Artificial Sequence
  T2A
GSGEGRGSLLTCGDVEENPGP

SEQ ID NO: 251 - DNA, 867 bp, Homo sapiens
  misc_feature: CD80
atgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataa

SEQ ID NO: 252 - DNA, 909 bp, Homo sapiens
  misc_feature: ICOSL
atgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttga

SEQ ID NO: 253 - protein, 254 aa, Homo sapiens
  MISC_FEATURE: Mature CD80(B7-1)
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 254 - protein, 306 aa, Homo sapiens
  MISC_FEATURE: Mature CD86(B7-2)
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 255 - protein, 272 aa, Homo sapiens
  MISC_FEATURE: Mature CD274 (PD-L1, B7-H1)
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 256 - protein, 254 aa, Homo sapiens
  MISC_FEATURE: Mature PDCD1LG2(PD-L2, CD273)
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 257 - protein, 284 aa, Homo sapiens
  MISC_FEATURE: Mature ICOSLG(B7RP1, CD275, ICOSL, B7-H2)
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 258 - protein, 506 aa, Homo sapiens
  MISC_FEATURE: Mature CD276(B7-H3)
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 259 - protein, 258 aa, Homo sapiens
  MISC_FEATURE: Mature VTCN1(B7-H4)
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 260 - protein, 202 aa, Homo sapiens
  MISC_FEATURE: Mature CD28
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 261 - protein, 188 aa, Homo sapiens
  MISC_FEATURE: Mature CTLA4
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 262 - protein, 268 aa, Homo sapiens
  MISC_FEATURE: Mature PDCD1(PD-1)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 263 - protein, 179 aa, Homo sapiens
  MISC_FEATURE: Mature ICOS
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 264 - protein, 259 aa, Homo sapiens
  MISC_FEATURE: Mature BTLA(CD272)
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 265 - protein, 433 aa, Homo sapiens
  MISC_FEATURE: Mature CD4
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 266 - protein, 214 aa, Homo sapiens
  MISC_FEATURE: Mature CD8A(CD8-alpha)
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 267 - protein, 189 aa, Homo sapiens
  MISC_FEATURE: Mature CD8B(CD8-beta)
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 268 - protein, 497 aa, Homo sapiens
  MISC_FEATURE: Mature LAG3
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 269 - protein, 280 aa, Homo sapiens
  MISC_FEATURE: Mature HAVCR2(TIM-3)
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 270 - protein, 492 aa, Homo sapiens
  MISC_FEATURE: Mature CEACAM1
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 271 - protein, 222 aa, Homo sapiens
  MISC_FEATURE: Mature TIGIT
MTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 272 - protein, 397 aa, Homo sapiens
  MISC_FEATURE: Mature PVR(CD155)
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 273 - protein, 507 aa, Homo sapiens
  MISC_FEATURE: Mature PVRL2(CD112)
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 274 - protein, 318 aa, Homo sapiens
  MISC_FEATURE: Mature CD226
EEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 275 - protein, 327 aa, Homo sapiens
  MISC_FEATURE: Mature CD2
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 276 - protein, 154 aa, Homo sapiens
  MISC_FEATURE: Mature CD160
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 277 - protein, 248 aa, Homo sapiens
  MISC_FEATURE: Mature CD200
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 278 - protein, 297 aa, Homo sapiens
  MISC_FEATURE: Mature CD200R1(CD200R)
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKLYIPYIILTIIILTIVGFIWLLKVNGCRKYKLNKTESTPVVEEDEMQPYASYTEKNNPLYDTTNKVKASEALQSEVDTDLHTL

SEQ ID NO: 279 - protein, 183 aa, Homo sapiens
  MISC_FEATURE: Mature NC R3 (NKp30)
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 280 - protein, 208 aa, Artificial Sequence
  CD80 v55 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 281 - protein, 208 aa, Artificial Sequence
  CD80 v56 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEIPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 282 - protein, 208 aa, Artificial Sequence
  CD80 v57 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 283 - protein, 208 aa, Artificial Sequence
  CD80 v58 ECD
VIHVTKEVKEVATLSCGHNVSVEELAQTDILWHKEGKIVLAMRSGDTNIWPEYKNRTIFDITNNLSIVILALRPSDEGTYVCRVLKYENDTPVLEHLAEVTLSVKADFPTPSISDFEIPSSNIRRIICSASGGFPEPHLSWLENGEELNAINTTVSQDPETELYAVSSKLDFNTTTNHSFMCLIKYGHLRVNQTFNWNTTKQEHFPDN

SEQ ID NO: 284 - protein, 208 aa, Artificial Sequence
  CD80 v59 ECD
VIHVTKEVKEVATLSCGHNVSVEELAQTDILWHKEGKIVLAMRSGDTNIWPEYKNRTILDITNNLSIVILALRPSDEGTYVCVVRKYENDTPVLEHLAEVTLSVKADFPTPSISDFEIPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 285 - protein, 208 aa, Artificial Sequence
  CD80 v60 ECD
VIHVTKEVKEVATLSCGRNVSVEELAQTDILWHKEGEIVLAMRSGDTNIWPEYKNRTIFDITNNLSIVIQALRPSDEGTYVCVVRKYENDTPVLEHLAEVTLSVKADFPTPSISDFEIPSSNIRRIICSASGGFPEPHLSWLENGEELNAINTTVSQDPETELYAVSSELDFNMTTNHSFMCLIKYGDLRVNQTFNWNTTKQEHFPDN

SEQ ID NO: 286 - protein, 208 aa, Artificial Sequence
  CD80 v61 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEIPSSNIRRITCSASGGFPEPHLSWLGNGEELNAINTTVSQDPETELYAVSSELDFNVTTNHSFMCLIKYGDLRVNQTFNWNTTKQEHFPDN

SEQ ID NO: 287 - protein, 208 aa, Artificial Sequence; identical to SEQ ID NO: 281
  CD80 v62 ECD

SEQ ID NO: 288 - protein, 208 aa, Artificial Sequence
  CD80 v63 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 289 - protein, 208 aa, Artificial Sequence
  CD80 v64 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEIPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 290 - protein, 208 aa, Artificial Sequence; identical to SEQ ID NO: 281
  CD80 v65 ECD

SEQ ID NO: 291 - protein, 208 aa, Artificial Sequence
  CD80 v66ECD
VIHVTKEVKEVATLSCGHNVSVEELAQTDILWHKEGKIVLAMRSGDTNIWPEYKNRTIFDITNNLSIVILALRPSDEGTYECVVRKYENDTPVLEHLAEVTLSVKADFPTPSISDFEIPSSNIRRITCSASGGFPEPHLSWLENGEELNAINTTVSQDPETELYAVSSELDFNMTTNHSFMCLIKYGDLRVNQTFNWNTTKQEHFPDN

SEQ ID NO: 292 - protein, 208 aa, Artificial Sequence
  CD80 v67 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADLPTPSISDFEIPSSNIRRIICSASGGFPEPHLSWLENGEELNAINTTVSQDPETELYAVSSELDFNMTTNHSFMCLIKYGDLRVNQTFNWNTTKQEHFPDN

SEQ ID NO: 293 - protein, 208 aa, Artificial Sequence
  CD80 v68 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEIPTSNIRRIICSASGGFPEPHLSWLENGEELNAINTTVSQDPETELYAVSSKLDFNMTTNHSFMCLIKYGDLRVNQTFNWNTTKQEHFPDN

SEQ ID NO: 294 - protein, 208 aa, Artificial Sequence; identical to SEQ ID NO: 289
  CD80 v69 ECD

SEQ ID NO: 295 - protein, 208 aa, Artificial Sequence
  CD80 v70 ECD
VIHVTKEVKEVATLSCGLNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEIPSSNIRRIICSASGGFPEPHLSWLENGEELNAINTTVSQDPETELYAVSSELDFNMTTNHSFMCLIKYGDLRVNQTFNWNTTKQEHFPDN

SEQ ID NO: 296 - protein, 208 aa, Artificial Sequence
  CD80 v71 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPSSNIRRITYSASGGFPEPHLSWLENGEELNAINTTVSQDPETELYAVSSKLDFNMTTNHSFMCLIKYGDLRVNQTFNWNTTKQEHFPDN

SEQ ID NO: 297 - protein, 208 aa, Artificial Sequence
  CD80 v72 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVFEHLAEVTLSVKADFPTPSISDFEIPTSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 298 - protein, 208 aa, Artificial Sequence
  CD80 v73 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 299 - protein, 208 aa, Artificial Sequence
  CD80 v74 ECD
VIHVTKEVKEVATLSCGLNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEIPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 300 - protein, 208 aa, Artificial Sequence
  CD80 v75 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPILEHRAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 301 - protein, 208 aa, Artificial Sequence
  CD80 v76 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPILEHRAEVTLSVKADFPTPSISDFEIPTSNIRRIICSASGGFPEPHLSWLENGEESNAINTTVSQDPETELYAVSSKLDFNMTTNHSFMCLIKYGHLRVNQTFNWNTTKQEHFPDN

SEQ ID NO: 302 - protein, 208 aa, Artificial Sequence
  CD80 v77 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEVPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 303 - protein, 208 aa, Artificial Sequence
  CD80 v78 ECD
VIHVTKEVKEVATLSCGHNVSVEELAQTDILWHKEGKIVLAMRSGDTNIWPEYKNRTIFDNTNNLSIVILALRPSDEGTYVCVVRKYENDTPVFEHLAEVTLSAKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 304 - protein, 208 aa, Artificial Sequence
  CD80 v79 ECD
VIHVTKEVKEVATLSCGHNVSVEELAQTDILWHKEGKIVLAMRSGDTNIWPEYKNRTIFDITNNLSIVILALRPSDEGTYVCVVRKYENDAPVFEHLAEVTLSVKADFPTPSISDFEVPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 305 - protein, 208 aa, Artificial Sequence
  CD80 v80 ECD
VIHVTKEVKEVATLSCGHNVSVEELAQTDILWHKEGKIVLAMRSGDTNIWPEYKNRTIFDISNNLSIVILALRPSDEGTYVCVVRKYENDTPVLEHLAEVTLSVKADFPTPSISDFEVPSSNIRRIICSASGGFPEPHLSWLENGEELNAINTTVSQDPETELYAVSSELDFNMATNHSFMCLIKYGHLRVNQTFNWNTTKQEHFPDN

SEQ ID NO: 306 - protein, 208 aa, Artificial Sequence
  CD80 v81 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDSEIPTSNIRRIICSASGGFPEPHLSWLENGEELNAINTTVSQDPETELYAVSSKLDFNMTTNHSFMCLIKYGDLRVNQTFNWNTTKQEHFPDN

SEQ ID NO: 307 - protein, 208 aa, Artificial Sequence
  CD80 v82 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPSSNIRRITCSASGGFPEPHLSWSENGEELNAINTTVSQDPETELYAVSSKLDFNMTTNHSFMCLIKYGDLRVNQTFNWNTTKQEHFPDN

SEQ ID NO: 308 - protein, 208 aa, Artificial Sequence
  CD80 v83 ECD
VIHVTKEVKEVATLSSGLNVSVEELAQTDILWHKEGKIVLAMRSGDTNIWPEYKNRTIFDITNNLSIVILALRPSDEGTYVCVVRKYENDTPVLEHLAEVTLSVKADFPAPSISDFEIPTSNIRRIICSTSGGFPEPHLSWLENGEELNAINTTVSQDPETELYAVSSKLDFNMTTNHSFMCLIKYGDLRVNQTFNWNTTKQEHFPDN

SEQ ID NO: 309 - protein, 208 aa, Artificial Sequence
  CD80 v84 ECD
VIHVTKEVKEVATLSCGHNVSVEELAQTDILWHKEGKIVLAMRSGDTNIWPEYKNRTIFDITNNLSIVILALRPSDEGTYECVVLKYEKDGFKREHLAEVTLSVKADFPTPSISDFEIPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 310 - protein, 208 aa, Artificial Sequence
  CD80 v85 ECD
VIHVTKEVKEVATLSCGHNVSVEELAQTDILWHKEGKIVLAMRSGDTNIWPEYKNRTIFDITNNLSIVIQALRPSGEGTYECVVLKYEKDGFKREHLAEVTLLVKADFPTPSISDFEIPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 311 - protein, 207 aa, Artificial Sequence
  CD80 v86 ECD
VIHVTKEVKEVATLSCGHNVSVEELAQTRIYWKEKKMVLTMMSGDMNIWPECKNRTIFDITNNLSIVILALRPSDEGTYECVVRKYENDTPVLEHLAEVTLSVKADFPTPSISDFEIPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 312 - protein, 208 aa, Artificial Sequence
  CD80 v87 ECD
VIHVTKEVKEVATLSCGHNVSVEELAQTRIYWQKEKKMVLTMMSGDMNIWPEYKNRTIFDISNNLSIVILALRPSDEGTYVCVVRKYENDTPVLEHLAEVTLSVKADFPTPSISDFEIPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 313 - protein, 208 aa, Artificial Sequence
  CD80 v88 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPTSNIRRIICLTSGGFPEPHLSWLENGEELNAINTTVSQDPETELYAVSSKLDFNMTTNHSFMCLIKYGDLRVNQTFNWNTTKQEHFPDN

SEQ ID NO: 314 - protein, 208 aa, Artificial Sequence
  CD80 v89 ECD
VIHVTKEVERSGNAVLWYNVSVEELAQTRIYWQKEKKMVLTMMSGDMNIWPECKNRTIFDITNNLSIVIQALRPSDEGTYECVVLKYEKGAFKREHLAEVTLSVKADFPTPSISDFEIPTSNIRRIICSASGGFPEPHLSWLENGEELDAITTTVSQDPETELYAVSSKLDFNMTTNHSFMCLIKYGDLRVNQTFNWNTTKQEHFPDN

SEQ ID NO: 315 - protein, 208 aa, Artificial Sequence
  CD80 v90 ECD
VIHVTKEVKEVATLSCGLNVSVEELAQTDILWHKEGKMVLAMRSGDTNIWPEYKNRTIFDITNNLSIVILALRPSDEGTYVCVVRKYENDTPVLEHLAEVTLSVKADFPTPSISDFEVPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 316 - protein, 208 aa, Artificial Sequence
  CD80 v91 ECD
VIHVTKEVKEVATLSCGHNVSVEELAQTRIYWQKEKKMVLTMMSGDMNIWPEYKNRTIFDITNNLSIVILALRPSDEGTYECVVLKYEEDAFEREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 317 - protein, 208 aa, Artificial Sequence
  CD80 v92 ECD
VIHVTKEVKEVATLSCGHNVPVEELAQTDILWHKEGKIVLAMRSGDTIIWPEYKNRTIFDITNNLSIAILALRPSDEGTYVCVVRKYENDTPVLEHLAEVTLSVKADFHTPSISDFEIPTSNIRRLICSTSGGFPEPHLSWLENGEELNAINTTVSQDPETELYAVSSILDFNMTTNHSFMCLIKYGHLRVNQTFNWNTTKQEHFPDN

SEQ ID NO: 318 - protein, 208 aa, Artificial Sequence
  CD80 v93 ECD
VIHVTKEVKEVATLSCGLNVSVEELAQTDILWHKEGKIVLAMRSGDTNIWPEYKNRTIFDITNNLSIVILALRLSDEGTNVCVVRKYENDTPVLEHRAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 319 - protein, 208 aa, Artificial Sequence
  CD80 v94 ECD
VIHVTKEVKEVATLSCGHNVPVEELAQTDILWHKEGKIVLAMRSGDTNIWPEYKNRTIFDITNNLSIVILALRLSDEGTNVCVVRKYENNTPVLEHLAEVTLSVKADFPTPSISDFEIPTSNIRRIICSASGGFPEPHLSWLENGEELSAINTTVSQDPETGLYAVSSKLDFNMTTNHSFMCLIKYGHLRVNQTFNWNTTKQEHFPDN

SEQ ID NO: 320 - protein, 208 aa, Artificial Sequence
  CD80 v95 ECD
VIHVTKEVKEVATLSCGLNVSVEELAQTDILWHKEGKIVLAMRSGDTNIWPEYKNRTIFDITNNLSIMILALRPSDEGTYVCVVRKYENDTPVLEHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 321 - protein, 208 aa, Artificial Sequence
  CD80 v96 ECD
VIHVTKEVKEVATLSCGHNVSVEELAQTDILWHKEGKIVLAMRSGDTNIWPEYKNRTIFDITNNLSIMILALRPSDEGTYVCVVRKYENDTPVLEHLAEVTLSVKADFPTPSISDFEIPTSNIRRIICSASGGFPEPHLSWLENGEELSAINTTVSQDPETELYAVSSKLDFNMTTNHSFMCLIKYGHLSVNQTFNWNTTKQEHFPDN

SEQ ID NO: 322 - protein, 208 aa, Artificial Sequence
  CD80 v97 ECD
VIHVTKEVKEVATLSCGLNVSVEELAQTDILWHKEGKIVLAMRSGDTNIWPEYKNRTIFDITNNLSIVILALRLSDEGTNVCVVRKYENDTPVLEHLAEVTLSVKADFPTPSISDFEIPTSNIRRIICSASGGFPEPHLSWLENGEELNAINTTVSQDPETELYAVSSKLDFNMTTNHSFMCLIKYGHLSVNQTFNWNTTKQEHFPDN

SEQ ID NO: 323 - protein, 208 aa, Artificial Sequence
  CD80 v98 ECD
VIHVTKEVKEVATLSGGHNVSAEELAQTDILWHKEGKIVLAMRSGDTNIWPEYKNRTIFDITNNLSIMILALRPSGEGTYVCVVRKYENDTPVLEHLAEVTLSVKADFPTPSISDFETPTSNIRRIICSASGGFPEPHLTWLENGEELSAINTTVSQDPETELYAVSSILDFNMTTNRSFMCLIKYGHLRVDQTFNWNTTKQEHFPDN

SEQ ID NO: 324 - protein, 208 aa, Artificial Sequence
  CD80 v99 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVFEHLAEVTLSVKADFPTPSISDFVTPTSNIRRIICSTSGGFPEPHLSWLENGEELSAINTTVSQDPETELYAVSGKLDFNMTTNHSFMCLIKYGQLRVNQTFNWNTTKQEHFPDN

SEQ ID NO: 325 - protein, 208 aa, Artificial Sequence
  CD80 v100 ECD
VIHVTKEVKEVATLSCGHNVSAEELAQTDILWHKEGKIVLAMRSGDTNIWPEYKNRTIFDITNNLSIMILALRPSDEGTYVCVVRKYENDTPVLEHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 326 - protein, 208 aa, Artificial Sequence
  CD80 v101 ECD
VIHVTKEVKEVATLSCGHNVSVEELAQTDILWHKEGKIVLAMRSGDTNIWPEYKNRTIFDITNSLSIVILALRPSDEGTYVCVVRKYENDTPVFEHLAEVTLSVKADFPTPSISDFETPTSNIRRIICSASGGFPEPHLSWLENGEELSAINTTVSQDPETELYAVSSILDFNMTTNHSFMCLIKYGHLRVNQTFNWNTTKQEHFPDN

SEQ ID NO: 327 - protein, 208 aa, Artificial Sequence
  CD80 v102 ECD
VIHVTKEVKEVATLSCGHNVSAEELAQTDILWHKEGKIVLAMRSGDTNIWPEYKNRTIFDITNNLSIMILALRPSDEGTYVCVVRKYENDTPVLEHLAEVTLSVKADFPTPSISGFETPTSNIRRIICSASGDFPEPHLSWLENGEELSAINTTVSQDPETELYAVSSKLDFNMTTNHSFMCLIKYGHLRVNQTFNWNTTKQEHFPDN

SEQ ID NO: 328 - protein, 208 aa, Artificial Sequence
  CD80 v103 ECD
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICPTSGGFPEPHLSWLENGEELNAINTTVSQDPETELYAVSSKLDFNMTTNHSFMCLIKYGHLRVNQTFNWNTTKQEHFPDN

SEQ ID NO: 329 - protein, 208 aa, Artificial Sequence
  CD80 v104 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLSVKADFPTPSISDFEIPTSNIRRIICPTSGGFPEPHLSWLENGEELNAINTTVSQDPETELYAVSSKLDFNMTTNHSFMCLIKYGHLRVNQTFNWNTTKQEHFPDN

SEQ ID NO: 330 - protein, 208 aa, Artificial Sequence
  CD80 v105 ECD
VIHVTKEVKEVATLSCGHNVSVEELAQTRIYWQKEKKMVLTMMSGDMNIWPEYKNRTIFDITNNLSIVTQALRPSDEGTYECVVLKYEKDGFKREHLAEVTLSVKADFPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 331 - protein, 208 aa, Artificial Sequence
  CD80 v106 ECD
VIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVTLSVKADFPTPSISDFEIPTSNIRRIICPTSGGFPEPHLSWLENGEELNAINTTVSQDPETELYAVSSKLDFNMTTNHSFMCLIKYGHLRVNQTFNWNTTKQEHFPDN

SEQ ID NO: 332 - protein, 208 aa, Artificial Sequence
  CD80 v107 ECD
VIHVTKEVKEVATLSCGHNVSVEELAQADILWHKEGKIVLAMRSGDTNIWPEYKNRTIFDITNNLSIVILALRPSDEGTYVCVVRKYENDTPVLEHLAEVTLSLKADFPTPSISDFEIPTSNIRRIICSASGGFPEPHLSWLENGEELSAINTTVSQDPETELYAVSSKLDFNMTTNHSFMCLIKYGHLRVNQTFNWNTTKQEHFPDN

SEQ ID NO: 333 - protein, 208 aa, Artificial Sequence
  CD80 v108 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHRAEVTLSVKADFPTPSISDFEIPTSNIRRIICSTSGGFPEPHLSWLENGEELSAINTTVSQDPETELYAVSSKLDFNMTTNHSFMCLIKYGQLRVNQTFNWNTTKQEHFPDN

SEQ ID NO: 334 - protein, 208 aa, Artificial Sequence
  CD80 v109 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHRAEVTLSVKADFPTPSISDFEIPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 335 - protein, 208 aa, Artificial Sequence
  CD80 v110 ECD
VIHVTKEVKEVATLSCGLNVSVEELAQTDILWHKEGKIVLAMRSGDTNIWPEYKNRTIFDITNNLSIAILALRPSDEGTYVCVVRKYENDTPVLEHLAEVTLSVKADFPTPSISDFEIPTSNIRRIICSASGGFPEPHLSWLENGEELSAINTIVSQDPETELYAVSSKLDFNMTTNHSFMCLIKYGHLRVNQTFNWNTTKQEHFPDN

SEQ ID NO: 336 - protein, 208 aa, Artificial Sequence
  CD80 v111 ECD
VIHVTKEVKEVGTLSCGHNVSVEELAQTDILWHKEGKIVLAMRSGDTNIWPEYKNRTIFDITNNLSIAILALRPSDEGTYVCVVRKYENDTPVLEHRAEVTLSVKADFPTPSISDFEIPTSNIRRIICSASGGFPEPHLSWLENGEELNAINTTVSQDPETELYAVSSKLDFNMTTNHSFMCHIKYGHLRVNQTFNWNTTKQEHFPDN

SEQ ID NO: 337 - protein, 208 aa, Artificial Sequence
  CD80 v112 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFETPTSNIRRIICSASGGFPEPHLTWLENGEELSAINTTVSQDPETELYAVSSSLDFNMTTNHSFMCLIKYGHLRVNQTFNWNTTKQEHFPDN

SEQ ID NO: 338 - protein, 208 aa, Artificial Sequence
  CD80 v113 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFETPTSNIRRIICSASGGFPEPHLSWLENGEELSAINTTVSQDPETELYAVSSILDFNMTTNHSFMCLIKYGHLRVNLTFNWNTTKQEHFPDN

SEQ ID NO: 339 - protein, 208 aa, Artificial Sequence
  CD80 v114 ECD
VIHVTKEVKEVATLSCGHNVSAEELAQTDILWHKEGKIVLAMRSGDTNIWPEYKNRTIFDITNNLSIVILALRPSDEGTYVCVVRKYENDTPVLEHLAEVTLSVKADFPTPSISDFETPTSNIRRIICSASGGFPEPHLSWLENGEELSAINTTVSQDPETELYAVSSKLDFNMTTNHSFMCLIKYGHLRVNQTFNWNTTKQEHFPDN

SEQ ID NO: 340 - protein, 208 aa, Artificial Sequence
  CD80 v115 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFETPTSNIRRIICSASGGFPEPHLSWLENGEELSAINTTVSQDPETELYAVSSKLDFNMTTNHSFMCLIKYGHLRVNQTFNWNTTKQEHFPDN

SEQ ID NO: 341 - protein, 208 aa, Artificial Sequence
  CD80 v116 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFETPTSNIRRIICSASGGFPEPHLSWLENGEELSAINTTVSQDPETELYAVSSILDFNMTTNHSFMCLIKYGHLRVNQTFNWNTTKQEHFPDN

SEQ ID NO: 342 - protein, 208 aa, Artificial Sequence
  CD80 v117 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVFEHLAEVTLSVKADFPTPSISDFEIPTSNIRRIICSASGGFPEPHLSWLENGEELSAINTTVSQDPETELYAVSSILDFNMTTNHSFMCLIKYGHLRVNQTFNWNTTKQEHFPDN

SEQ ID NO: 343 - protein, 208 aa, Artificial Sequence
  CD80 v118 ECD
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFETPTSNIRRIIRSTSGGFPEPHLSWLENGEELNAINTTVSQDPETELYAVSSKLDFNMTTNHSFMCLIKYGHLRVNQTFNWNTTKQEHFPDN

SEQ ID NO: 344 - protein, 208 aa, Artificial Sequence
  CD80 v119 ECD
VIHVTKEVKEVATLSCGHNVSVEELARTCIYWQKEKKMVLTTMSGDMNIWPEYKNRTIFDITNNLSIVILALRPSDEGTYECVVLKYEKDAFKREHLAEVTLSVKADFPTPSISDFEIPTSNIRRIICPTSGGFPEPHLSWLENGEELNAINTTVSQDPGTELYAVSSKLDFNMTTNHSFMCLIKYGHLRVNQTFNWNTTKQEHFPDN

SEQ ID NO: 345 - protein, 208 aa, Artificial Sequence
  CD80 v120 ECD
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICPTSGGFPEPHLSWLENGEELNAINTAVSQDPETELYAVSSKLDFNMTTNHSFMCLIKYGHLRVNQTFNWNTTKQEHFPDN

SEQ ID NO: 346 - protein, 208 aa, Artificial Sequence
  CD80 v121 ECD
VIHVTKEVKEVATLSCGHNVPVEELAQTRIYWQKEKKMVLTMMSGDMNIWPEYKNRTIFDITNNLSIVIQALRPSDEGTYECVVLKYEKGAFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 347 - protein, 101 aa, Artificial Sequence
  CD80 v93 IgV
VIHVTKEVKEVATLSCGLNVSVEELAQTDILWHKEGKIVLAMRSGDTNIWPEYKNRTIFDITNNLSIVILALRLSDEGTNVCVVRKYENDTPVLEHRAEVT

SEQ ID NO: 348 - protein, 414 aa, Homo sapiens
  MISC_FEATURE: VSIG8
MRVGGAFHLLLVCLSPALLSAVRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 349 - protein, 393 aa, Homo sapiens
  MISC_FEATURE: Mature VSIG8
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 350 - protein, 242 aa, Homo sapiens
  MISC_FEATURE: VSIG8 ECD
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIG

SEQ ID NO: 351 - protein, 16 aa, Artificial Sequence
  CD33 Signal Peptide
MPLLLLLPLLWAGALA

SEQ ID NO: 352 - protein, 22 aa, Artificial Sequence
  IgGkappa light chain
MDMRVLAQLLGLLLLCFPGARC

SEQ ID NO: 353 - protein, 18 aa, Artificial Sequence
  HSA signal peptide
MKWVTFISLLFLFSSAYS

SEQ ID NO: 354 - protein, 22 aa, Artificial Sequence
  Ig kappa light chain
MDMRAPAGIFGFLLVLFPGYRS

SEQ ID NO: 355 - protein, 19 aa, Artificial Sequence
  Human azurocidin preprotein signal sequence
MTRLTVLALLAGLLASSRA

SEQ ID NO: 356 - protein, 19 aa, Artificial Sequence
  IgG heavy chain signal peptide
MELGLSWIFLLAILKGVQC

SEQ ID NO: 357 - protein, 19 aa, Artificial Sequence
  IgG heavy chain signal peptide
MELGLRWVFLVAILEGVQC

SEQ ID NO: 358 - protein, 19 aa, Artificial Sequence
  IgG heavy chain signal peptide
MKHLWFFLLLVAAPRWVLS

SEQ ID NO: 359 - protein, 19 aa, Artificial Sequence
  IgG heavy chain signal peptide
MDWTWRILFLVAAATGAHS

SEQ ID NO: 360 - protein, 19 aa, Artificial Sequence
  IgG heavy chain signal peptide
MDWTWRFLFVVAAATGVQS

SEQ ID NO: 361 - protein, 19 aa, Artificial Sequence
  IgG heavy chain signal peptide
MEFGLSWLFLVAILKGVQC

SEQ ID NO: 362 - protein, 19 aa, Artificial Sequence
  IgG heavy chain signal peptide
MEFGLSWVFLVALFRGVQC

SEQ ID NO: 363 - protein, 26 aa, Artificial Sequence
  IgG heavy chain signal peptide
MDLLHKNMKHLWFFLLLVAAPRWVLS

SEQ ID NO: 364 - protein, 22 aa, Artificial Sequence
  IgG Kappa light chain signal sequences
MDMRVPAQLLGLLLLWLSGARC

SEQ ID NO: 365 - protein, 22 aa, Artificial Sequence
  IgG Kappa light chain signal sequences
MKYLLPTAAAGLLLLAAQPAMA

SEQ ID NO: 366 - protein, 17 aa, Artificial Sequence
  Gaussia luciferase
MGVKVLFALICIAVAEA

SEQ ID NO: 367 - protein, 18 aa, Artificial Sequence
  Human albumin
MKWVTFISLLFLFSSAYS

SEQ ID NO: 368 - protein, 18 aa, Artificial Sequence
  Human chymotrypsinogen
MAFLWLLSCWALLGTTFG

SEQ ID NO: 369 - protein, 14 aa, Artificial Sequence
  Human interleukin-2
MQLLSCIALILALV

SEQ ID NO: 370 - protein, 15 aa, Artificial Sequence
  Human trypsinogen-2
MNLLLILTFVAAAVA

SEQ ID NO: 371 - protein, 18 aa, Artificial Sequence
  CD80 trailing sequence
LSVKADFPTPSISDFEIP

SEQ ID NO: 372 - protein, 107 aa, Homo sapiens
  MISC_FEATURE: CD80 IgV wildtype
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKAD

SEQ ID NO: 373 - protein, 107 aa, Artificial Sequence
  CD80 v46 IgV
VIHVTKEVKEVATLSCGHNVSVEELAQTRIYWQKEKKMVLTMMSGDMNIWPEYKNRTIFDITNNLSIVILALRPSDEGTYECVVLKYERKGYRREHLAEVTLSVKAD

SEQ ID NO: 374 - protein, 107 aa, Artificial Sequence; identical to SEQ ID NO: 372
  CD80 v1 IgV

SEQ ID NO: 375 - protein, 107 aa, Artificial Sequence
  CD80 v20 IgV
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLSVKAD

SEQ ID NO: 376 - protein, 107 aa, Artificial Sequence
  CD80 v43 IgV
VIHVTKEVKEVATLSCGHNVSVEELAQTVIYWQKEKKMVLTMQSGDMNIWPEYKNRTIFDITNNLSIVILALRPSDEGTYRCVVIKYERLENQGEHLAEVTLSVKAD

SEQ ID NO: 377 - protein, 107 aa, Artificial Sequence
  CD80 v44 IgV
VIHVTKEVKEVATLSCGHNVSVEELAQTRIYWQKEKKMVLIMMSGDMNIWPEYKNRTIFDITNNLSIVILALRPSDEGTYECVVLKYEKDGFKREHLAEVTLSVKAD

SEQ ID NO: 378 - protein, 107 aa, Artificial Sequence
  CD80 v18 IgV
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLPVKAD

SEQ ID NO: 379 - protein, 107 aa, Artificial Sequence
  CD80 v48 IgV
VIHVTKEVKEVATLSCGHNVSVEELAQTRIYWQKEKKMVLTMMSGDMNIWPEYKNRTIFDITNNLSIVILALRPSDEGTYECVVLKYDRKGYRREHLAEVTLSVKAD

SEQ ID NO: 380 - protein, 107 aa, Artificial Sequence
  CD80 v49 IgV
VIHVTKEVKEVATLSCGHNVSVEELAQTRIYWQKEGQIVMTMMSGDMNIWPEYKNRTIFDITNNLSIVILALRPSDEGTYECVVLKYEKDAFKREHLAEVTLSVKAD

SEQ ID NO: 381 - protein, 107 aa, Artificial Sequence
  CD80 v50 IgV
VIHVTKEVKEVATLSCGHNVSVEELAQTRIYWQKEGKMVLTMMSGDMNIWPEYKNRTIFDITNNLSIVILALRPSDEGTYECVVLKYEKDAFKREHLAEVTLSVKAD

SEQ ID NO: 382 - protein, 107 aa, Artificial Sequence
  CD80 v53 IgV
VIHVTKEVKEVATLSCGHNVSVEELAQTVIFWQKEGKLVLTMQSGDMNIWPEYKNRTIFDITNNLSIVILALRPSDEGTYRCIVIKYERLENQGEHLAEVTLSVKAD

SEQ ID NO: 383 - protein, 107 aa, Artificial Sequence
  CD80 v54 IgV
VIHVTKEVKEVATLSCGHNVSVEELAQTRIYWQKEKKMVLTMMSGDMNIWPEYKNRTIFDITNNLSIMIPAPRPSDEGTYECVVLEYEKDAFKREHLAEVTLSVKAD

SEQ ID NO: 384 - protein, 107 aa, Artificial Sequence
  CD80 v93 IgV
VIHVTKEVKEVATLSCGLNVSVEELAQTDILWHKEGKIVLAMRSGDTNIWPEYKNRTIFDITNNLSIVILALRLSDEGTNVCVVRKYENDTPVLEHRAEVTLSVKAD

SEQ ID NO: 385 - protein, 107 aa, Artificial Sequence
  CD80 v19 IgV
VIHVTKEVKEVATLSCGHNVSVEELAQTRIYWQKEKKMVLTMMSGDMNIWPEYKNRTIFDITNNLSIVILALRPSDEGTYECVVLKYEEDAFKREHLAEVTLSVKAD

SEQ ID NO: 386 - protein, 107 aa, Artificial Sequence
  CD80 v29 IgV
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTSSVKAD

SEQ ID NO: 387 - protein, 232 aa, Artificial Sequence
  Knob Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 388 - protein, 232 aa, Artificial Sequence
  Hole Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 389 - protein, 232 aa, Artificial Sequence
  Stack Fc (homodimeric)
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 390 - protein, 8 aa, Artificial Sequence
  Stuffer
HMSSVSAQ

SEQ ID NO: 391 - protein, 18 aa, Artificial Sequence
  CD80 WT linker 1 (including first 3 aa)
LSVKADFPTPSISDFEIP

SEQ ID NO: 392 - protein, 232 aa, Artificial Sequence
  Fc (C5S (C220S), R77C, (R292C),  N82G (N297G), V87C (V302C))
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 393 - protein, 232 aa, Artificial Sequence
  Fc with C220S/L234A/L235E/G237A
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 394 - protein, 231 aa, Artificial Sequence
  Fc with C220S/E233P/L234V/L235A/G236del/S267K
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 395 - protein, 431 aa, Artificial Sequence
  antiCD19x28z chimeric antigen receptor: protein
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 396 - protein, 21 aa, Artificial Sequence
  CD8-derived signal sequence
MALPVTALLLPLALLLHAARP

SEQ ID NO: 397 - protein, 23 aa, Artificial Sequence
  CD8-derived signal sequence
MALPVTALLLPLALLLHAARPGS

SEQ ID NO: 398 - protein, 245 aa, Artificial Sequence
  anti-CD19 scFv (2nd gen CAR)
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 399 - protein, 69 aa, Artificial Sequence
  CD8-derived hinge and transmembrane domain (2nd gen CAR)
AKPTTTPAPRPPTPAPTIASQPLSLRPEACRPAAGGAVHTRGLDFACDIYIWAPLAGTCGVLLLSLVIT

SEQ ID NO: 400 - protein, 42 aa, Artificial Sequence
  4-1BB-derived costimulatory domain
KRGRKKLLYIFKQPFMRPVQTTQEEDGCSCRFPEEEEGGCEL

SEQ ID NO: 401 - protein, 40 aa, Artificial Sequence
  CD28-derived costimulatory domain
SKRSRLLHSDYMNMTPRRPGPTRKHYQPYAPPRDFAAYRS

SEQ ID NO: 402 - protein, 41 aa, Artificial Sequence
  CD28-derived costimulatory domain 2
RSKRSRLLHSDYMNMTPRRPGPTRKHYQPYAPPRDFAAYRS

SEQ ID NO: 403 - protein, 44 aa, Artificial Sequence
  CD28-derived costimulatory domain 3
FWVRSKRSRLLHSDYMNMTPRRPGPTRKHYQPYAPPRDFAAYRS

SEQ ID NO: 404 - protein, 20 aa, Artificial Sequence
  T2A protein
SGEGRGSLLTCGDVEENPGP

SEQ ID NO: 405 - protein, 232 aa, Artificial Sequence
  Blue fluorescent protein
SELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 406 - protein, 472 aa, Artificial Sequence
  2nd Gen CAR (without signal sequence or T2A or BFP)
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 407 - protein, 497 aa, Artificial Sequence
  2nd Gen CAR with T2A
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGRSGEGRGSLLTCGDVEENPGPSR

SEQ ID NO: 408 - protein, 471 aa, Artificial Sequence
  2nd Gen CAR with CD28-derived costimulatory domain (without signal sequence or T2A or BFP)
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 409 - protein, 270 aa, Artificial Sequence
  Nkp30 stack
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGGGGGSGGGGSAAAEPK

SEQ ID NO: 410 - protein, 116 aa, Artificial Sequence
  NKp30 v1 IgC-like (long)
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQL

SEQ ID NO: 411 - protein, 229 aa, Artificial Sequence
  IgG4 Fc
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 412 - protein, 229 aa, Artificial Sequence
  IgG4 Fc S228P
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 413 - protein, 232 aa, Artificial Sequence
  IgG1 Fc C220S
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 414 - protein, 208 aa, Artificial Sequence
  CD80 v122 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEIPTSNIRRIICSTSGGFPEPHLSWLEDGEELNAINTTVSQDPETELYAVSSKLDFNMTTNHSFMCLIKYGHLRVNQTFNWNTTKQEHFPDN

SEQ ID NO: 415 - protein, 208 aa, Artificial Sequence
  CD80 v123 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEAPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 416 - protein, 208 aa, Artificial Sequence
  CD80 v124 ECD
VIHMTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 417 - protein, 208 aa, Artificial Sequence
  CD80 v125 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 418 - protein, 208 aa, Artificial Sequence
  CD80 v126 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVSQTFNWNTTKQEHFPDN

SEQ ID NO: 419 - protein, 208 aa, Artificial Sequence
  CD80 v127 ECD
VIHVTKEVKEVATLSCGHNLSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 420 - protein, 208 aa, Artificial Sequence
  CD80 v128 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFGVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 421 - protein, 208 aa, Artificial Sequence
  CD80 v129 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 422 - protein, 208 aa, Artificial Sequence
  CD80 v130 ECD
VIHVTKEVKEVATLSCGHNVSVEELAQTRIYWQKEKKMVLTMMSGDMNIWPEYKNRTIFDITNNLSIVIRALRPSDEGTYECVVLKYEKDGFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNSTKQEHFPDN

SEQ ID NO: 423 - protein, 208 aa, Artificial Sequence
  CD80 v131 ECD
VIHVTKEVKEVATLSCGHNVSVEELAQTRIYWQKEKKMVLTMMSGDMNIWPEYKNRTIFDITNNLSIVIQALRPSDEGTYACVVLKYEKDGFKREHLAEVTLSVKADFPTPSISDFEVPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 424 - protein, 208 aa, Artificial Sequence
  CD80 v132 ECD
VIHVTKEVKEVATLSCGHNVSVEELAQSRIYWQKEKKMVLTMMSGDMNIWPEYKNRTIFDITNNLSIVIQALRPSDEGTYECVVLKYEKDGFKRKHLAEVTLSVKADFPTPSISDFEVPSSNIRRVICSASGGFPEPHLSWLENGEELNAINTTVSQDPETELYAVSNKLDFNMTTNHSFMCLIKYGHLRVNQTFNWNTTKQEHFPDN

SEQ ID NO: 425 - protein, 208 aa, Artificial Sequence
  CD80 v133 ECD
VIHVTKEVKEVATLSCGHNVSVEELAQTRIYWQKEKKMVLTMMSGDMNIWPEYKNRTIFDITSNLSIVIQALRPSDEGTYECVVLKYEKDGFKREHLAEVTLSVKADFPTPSITDFEVPSSNIRRIICSASGGFPEPHLSWLENGEELNAINTTVSQDPETELYAVSSKLDFNMTTNHSFMCLIKYGDLRVNQTFNWNTTKQEHFPDN

SEQ ID NO: 426 - protein, 208 aa, Artificial Sequence
  CD80 v134 ECD
VIHVTKEVKEVATLSCGHNVSVEELAQTRIYWQKEEKMVLTMMSGDMNIWPEYKNRTIFDITNNLSTVIQALRPSDEGTYECVVLKYEKDGFKREHLAEVTLSVKADFPTPSISDFEVPSSNIRRIICSASGGFPEPHLSWLENGEELNAITTTVSQDPETELYAVSSKLDFNMTTNHSFMCLIKYGHLRVNQTFNWNTTKQEHFPDN

SEQ ID NO: 427 - protein, 208 aa, Artificial Sequence
  CD80 v135 ECD
VIHVTKEVKEVATLSCGHNVSVEELAQTRIYWQKEKKMVLTMMSGDMNIWPGYKNRTIFDITNNLSIVIQALRPSDEGTYECVVLKYEKDGFKREHLAEVTLSVKANFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 428 - protein, 208 aa, Artificial Sequence
  CD80 v136 ECD
VIHVTKEVKEVATLSCGHNVSVEELAQTRIYWQKEKEMVLTMMSGDMNIWPEYKNRTISDITNNLSIVIQALRPSDEGTYECVVLKYEKDGFKREHLAEVTLSVKADFPTPSISDFEVPSSNIRRIICSASGGFPEPHLSWLENGEELNAINTTVSQDPETELYAVSSKLDFNMTTNHSFMCLIEYGHLRVNQTFNWNTTKQEHFPDN

SEQ ID NO: 429 - protein, 208 aa, Artificial Sequence
  CD80 v137 ECD
VIHVTKEVKEVATLSCGHNVSVEELAQTRIYWQKEKKMVLTMMSGDMNIWPEYKNRTIFVITNNLSIVILALRPSDEGTYECVVLKYEKDGFKREHLAEVTLSVKADFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 430 - protein, 208 aa, Artificial Sequence
  CD80 v138 ECD
VIHVTKEVKEVATLSCGHNVSVEELAQTRIYWQKEKKMVLTMMSGDMNIWPEYMNRTIFDITNNLSIVIQALRPSDEGTYECVVLKYEKDGFKREHLAEVTLSVKADFPTPSISDFEIPTSNIRRIICSTSGGFPEPHLSWLENGEELNAINTTVSQDPETELHAVSSKLDFNMTTNHSFMCLIKYGDLRVNQTFNWNTTKQEHFPDN

SEQ ID NO: 431 - protein, 208 aa, Artificial Sequence
  CD80 v139 ECD
VIHVTKEVKEVATLSCGHNVSVEELAQTRIYWQKEKKTVLTMMSGDMNIWPEYKNRTIFDITNNLSIVIQALRPSDGGTYECVVLKYEKDGFKREHLAEVTLSVKADFPTPSISDFEVPSSNIRRIICSASGGFPEPHLSWLENGEELNAITTTVSQDPETELYAVSSKLDFNMTTNHSFMCLIKYGHLRVNQTFNWNTTKQEHFPDN

SEQ ID NO: 432 - protein, 208 aa, Artificial Sequence
  CD80 v140 ECD
VIHVTKEVKEVATLSCGHNVSVEELAQTRIHWQKEKKMVLGMLSGDMNIWPEYKNRTIFDITNNLSIVIQALRPSDEGTYECVVLKYEKDGFKREHLAEVTLSVKADFPTPSISDFEVPSSNIRRVICSASGGFPEPHLSWLENGEELNAINTTVSQDPETELYAVSSKLDFNMTTNHSFMCLIKYGHLRVNQTFNWNTTKQEHFPDN

SEQ ID NO: 433 - protein, 208 aa, Artificial Sequence
  CD80 v141 ECD
VIHVTKEVKEVATLSCGHNVSVEELAQTRIYWQKEKKMVLTMMSGDMNIWPEYKNRTIFDITNNHSIVILALRPSDEGTYECVVLKYEKGAFKREHLAEVTLSVKADFPAPSISDLEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 434 - protein, 208 aa, Artificial Sequence
  CD80 v142 ECD
VIHVTKEVKEVATLSCGHNVSVEELAQTHIYWQKEKKMVLTMMSGDMNIWPGYKNRTIFDITNNLSIVILALRPSDEGTYECVVLKYEKNAFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 435 - protein, 208 aa, Artificial Sequence; identical to SEQ ID NO: 434
  CD80 v143 ECD

SEQ ID NO: 436 - protein, 208 aa, Artificial Sequence
  CD80 v144 ECD
VIHVTKEVKEVATLSCGHNVSVEELAQTRIYWQKEKKMVLTMMSGDMNIWPEYKNRTIFDITNNLSTVIQALRPSDEGTYECVVLKYEKDGFKREHLAEVTLSVKADFPTPSISDFEVPSSNIRRIICSTSGGFPEPHLSWLENGEELNAINTTVSQDPETELYAVSSKLDFNMTTNHSFMCLIKYGHLRVNQTFHWNTTKQEHFPDN

SEQ ID NO: 437 - protein, 208 aa, Artificial Sequence
  CD80 v145 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPAPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 438 - protein, 208 aa, Artificial Sequence
  CD80 v146 ECD
VIHVTKEVKEVATLSCGHNVSVEELAQTRIYWQKEKKVVLDMISGDMNIGPEYKNRTIFDITNNLSIVILALRPSGEGTYECAVLKYEEDAFKREHLAEVTLSVKADFPTPSISDFEVPSSNIRRVICSASGGFPEPHLSWLENGEELNAINTTVSQDPETELYAVSSKLDFNMTTNHSFMCLIKYGHLRVNQTFNWNTTKQEHFPDN

SEQ ID NO: 439 - protein, 208 aa, Artificial Sequence
  CD80 v147 ECD
VIHVTKEVKEVVTLFCGHNVSVEELAQTRIHWQKEKKLVLGMLSGDMNIWPEYKNRTIFDITNNLSIVILALRPSDEGTYECVVLKYEKNAFKREHLAEVTLSVKADFPTPSISDFEIPTSNIRRIICSASGGFPELHLSWLENGEELDAITTTVSQDPETELYAVSSKLDFNMTTNHSFMCLIKYGHLRVNQTFNWNTTKQEHFPDN

SEQ ID NO: 440 - protein, 208 aa, Artificial Sequence
  CD80 v148 ECD
VIHVTKEVKEVATLSCGHNVSVEELAQTRIYWQKEKKMVLTMMSGDMNIWPEYKNRTIFDITNNLSFVIRALRPSDEGTYECVVLKYGKDGFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 441 - protein, 208 aa, Artificial Sequence
  CD80 v149 ECD
VIHVTKEVKEVATLSCGHNVSVEGPAQTRIYWQKEKKMVLTMMSGDMNIWPEYKNRTIFDITNNLSIVIQALRPSDEGTYECVVLKYEKDGFKREHLAEVTLSVKADFPTPSISDFEVPSSNIRRIICSTSGGFPEPHLSWLENGEELNAITTTVSQDPETELYAVSSKLDFNMTTNHSFMCLIKYGHLRVNQTFNWNTTKQEHFPDN

SEQ ID NO: 442 - protein, 208 aa, Artificial Sequence
  CD80 v150 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGLKREHLAEVTLSVKADLPTPSISDFEVPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 443 - protein, 208 aa, Artificial Sequence
  CD80 v151 ECD
VIHVTKEVKEVATLSCGHNVSVEELAQTRIYWQKEKKMVLTMMSGDMNIWPEYKNRTIFDITNNLSIVILALRPSDEGTYECVVLKYDRKGYRREHLAEVTLSVKADFPTPSISDFEIPTSSIRRIICSTSGGFPEPHLSWLENGEELNAINTTVSQDPETELYAVSSKLDFNMTTSHSFMCLIKYGHLRVNQTFNWNTTKQEHFPDN

SEQ ID NO: 444 - protein, 208 aa, Artificial Sequence
  CD80 v152 ECD
VIHVTKEVKEVATLSCGHNVSVEELAQTRIYWQKEGQIVMTMMSGDMNIWPEYKNRTILDITNNLSIVILALRPSDEGTYVCVVRKYENDTPVLEHLAGVTLSVKADFPTPSISDFEIPTSNIRRIICSASGGFPEPHLSWLENGEELSAINTTVSQDPETELYAVSSKLDFNMTTNHSFMCLIKYGHLRVNQTFNWNTTKQEHFPDN

SEQ ID NO: 445 - protein, 208 aa, Artificial Sequence
  CD80 v153 ECD
VIHVTKEVKEVATLSCGHNVSVEELAQTRIYWQKEGKMVMTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 446 - protein, 208 aa, Artificial Sequence
  CD80 v154 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEVPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 447 - protein, 208 aa, Artificial Sequence
  CD80 v155 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEVPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 448 - protein, 208 aa, Artificial Sequence; identical to SEQ ID NO: 302
  CD80 v156 ECD

SEQ ID NO: 449 - protein, 208 aa, Artificial Sequence
  CD80 v157 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEVPSSNIRRIICSASGGFPEPHLSWLENGEELNAINTTVSQDPETELYAVSSELDFNTTTNHSFMCLIKYGHLRVNQTFNWNTTKQEHFPDN

SEQ ID NO: 450 - protein, 208 aa, Artificial Sequence
  CD80 v158 ECD
VIHVTKEVKEVATLSCGHNVSVEELAQTDILWHKEGKIVLAMRSGDTDIWPEYKNRTILDITNNLSIVILALRPSDEGTYVCVVRKYENDTPVLEHLAEVTLSVKADFPTPSISDFEVPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 451 - protein, 208 aa, Artificial Sequence
  CD80 v159 ECD
VIHVTKEVKEVATLSCGRNVSVEELAQTDILWHKEGEIVLAMRSGDTNIWPEYKNRTIFDITNNLSIVIQALRPSDEGTYVCVVRKYENDTPVLEHLAEVTLSVKADFPTPSISDFEVPSSNIRRIICSASGGFPEPHLSWLENGEELNAINTTVSQDPETELYAVSSELDFNMTTNHSFMCLIKYGDLRVNQTFNWNTTKQEHFPDN

SEQ ID NO: 452 - protein, 208 aa, Artificial Sequence
  CD80 v160 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEVPSSNIRRITCSASGGFPEPHLSWLGNGEELNAINTTVSQDPETELYAVSSELDFNVTTNHSFMCLIKYGDLRVNQTFNWNTTKQEHFPDN

SEQ ID NO: 453 - protein, 208 aa, Artificial Sequence
  CD80 v161 ECD
VIHVTKEVKEVATLSCGHNVSVEELAQTDVLWHKEGKIVLAMRSGDTNIWPEYKNRTIFDITNNLSIVILALRPSDEGTYVCVVRKYENDTPVLEHLAEVTLSVKADFPTPSISDFEVPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 454 - protein, 208 aa, Artificial Sequence
  CD80 v162 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEVPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 455 - protein, 208 aa, Artificial Sequence
  CD80 v163 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEVPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 456 - protein, 208 aa, Artificial Sequence
  CD80 v164 ECD
VIHVTKEVKEVATLSCGHNVSVEELAQTDILWHKEGKIVLAMRSGDTNIWPEYKNRTIFDITNNLSIVIQALRPSDEGTYVCVVLKYENDTPVLEHLAEVTLSVKADFPTPSISDFEVPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 457 - protein, 208 aa, Artificial Sequence
  CD80 v165 ECD
VIHVTKEVKEVATLSCGHNVSVEELAQTDILWHKEGKIVLAMRSGDTNIWPEYKNRTIFDITNNLSIVILALRPSDEGTYECVVRKYENDTPVLEHLAEVTLSVKADFPTPSISDFEVPSSNIRRITCSASGGFPEPHLSWLENGEELNAINTTVSQDPETELYAVSSELDFNMTTNHSFMCLIKYGDLRVNQTFNWNTTKQEHFPDN

SEQ ID NO: 458 - protein, 208 aa, Artificial Sequence
  CD80 v166 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADLPTPSISDFEVPSSNIRRIICSASGGFPEPHLSWLENGEELNAINTTVSQDPETELYAVSSELDFNMTTNHSFMCLIKYGDLRVNQTFNWNTTKQEHFPDN

SEQ ID NO: 459 - protein, 208 aa, Artificial Sequence
  CD80 v167 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEVPSSNIRRIICSASGGFPEPHLSWLENGEELDAINTTVSQDPETELYAVSSELDFNMTTNHSFMCLIKYGDLRVNQTFNWNTTKQEHFPDN

SEQ ID NO: 460 - protein, 208 aa, Artificial Sequence
  CD80 v168 ECD
VIHVTKEVKEVATLSCGLNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEVPSSNIRRIICSASGGFPEPHLSWLENGEELNAINTTVSQDPETELYAVSSELDFNMTTNHSFMCLIKYGDLRVNQTFNWNTTKQEHFPDN

SEQ ID NO: 461 - protein, 208 aa, Artificial Sequence
  CD80 v169 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEVPSSNIRRITYSASGGFPEPHLSWLENGEELNAINTTVSQDPETELYAVSSKLDFNMTTNHSFMCLIKYGDLRVNQTFNWNTTKQEHFPDN

SEQ ID NO: 462 - protein, 208 aa, Artificial Sequence
  CD80 v170 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLADVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 463 - protein, 208 aa, Artificial Sequence
  CD80 v171 ECD
VIHVTKEVKEVATLSCGLNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 464 - protein, 208 aa, Artificial Sequence
  CD80 v172 ECD
VIHVTKEVKEVATLSCGHNVSVEELAQTDILWHKEGKIVLAMRSGDTNIWPEYKNRTIFDNTNNLSIVILALRPSDEGTYVCVVRKYENDTPVFEHLAEVTLSAKADFPTPSISDFEVPSSNIRRVICSASGGFPEPHLSWLENGEELNAINTTVSQDPETELYAVSSKLDFNMTTNHSFMCLIKYGHLRVNQTFNWNTTKQEHFPDN

SEQ ID NO: 465 - protein, 208 aa, Artificial Sequence
  CD80 v173 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVFEHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 466 - protein, 208 aa, Artificial Sequence; identical to SEQ ID NO: 305
  CD80 v174 ECD

SEQ ID NO: 467 - protein, 208 aa, Artificial Sequence
  CD80 v175 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEVPSSNIRRITCSASGGFPEPHLSWSENGEELNAINTTVSQDPETELYAVSSKLDFNMTTNHSFMCLIKYGDLRVNQTFNWNTTKQEHFPDN

SEQ ID NO: 468 - protein, 208 aa, Artificial Sequence
  CD80 v176 ECD
VIHVTKEVKEVATLSSGLNVSVEELAQTDILWHKEGKIVLAMRSGDTNIWPEYKNRTIFDITNNLSIVILALRPSDEGTYVCVVRKYENDTPVLEHLAEVTLSVKADFPAPSISDFEVPTSNIRRIICSTSGGFPEPHLSWLENGEELNAINTTVSQDPETELYAVSSKLDFNMTTNHSFMCLIKYGDLRVNQTFNWNTTKQEHFPDN

SEQ ID NO: 469 - protein, 208 aa, Artificial Sequence
  CD80 v177 ECD
VIHVTKEVKEVATLSCGHNVSVEELAQTDILWHKEGKIVLAMRSGDTNIWPEYKNRTIFDITNNLSIVILALRPSDEGTYECVVLKYEKDGFKREHLAEVTLSVKADFPTPSISDFEVPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 470 - protein, 208 aa, Artificial Sequence
  CD80 v178 ECD
VIHVTKEVKEVATLSCGHNVSVEELAQTDILWHKEGKIVLAMRSGDTNIWPEYKNRTIFDITNNLSIVIQALRPSGEGTYECVVLKYEKDGFKREHLAEVTLLVKADFPTPSISDFEVPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 471 - protein, 208 aa, Artificial Sequence
  CD80 v179 ECD
VIHVTKEVKEVATLSCGHNVSVEELAQTRIYWQKEKKMVLTMMSGDMNIWPECKNRTIFDITNNLSIVILALRPSDEGTYECVVRKYENDTPVLEHLAEVTLSVKADFPTPSISDFEVPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 472 - protein, 208 aa, Artificial Sequence
  CD80 v180 ECD
VIHVTKEVKEVATLSCGHNVSVEELAQTRIYWQKEKKMVLTMMSGDMNIWPEYKNRTIFDISNNLSIVILALRPSDEGTYVCVVRKYENDTPVLEHLAEVTLSVKADFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 473 - protein, 208 aa, Artificial Sequence
  CD80 v181 ECD
VIHVTKEVKEVATLSCGHNVSVEELAQTRIYWQKEKKMVLTMMSGDMNIWPECKNRTIFDITNNLSIVIQALRPSDEGTYECVVLKYEKGAFKREHLAEVTLSVKADFPTPSISDFEIPTSNIRRIICSASGGFPEPHLSWLENGEELDAITTTVSQDPETELYAVSSKLDFNMTTNHSFMCLIKYGDLRVNQTFNWNTTKQEHFPDN

SEQ ID NO: 474 - protein, 208 aa, Artificial Sequence
  CD80 v182 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEVPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 475 - protein, 208 aa, Artificial Sequence
  CD80 v183 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPTSNIRRIICSASGGFPEPHLSWLENGEELSAINTTVSQDPETELYAVSSKLDFNMTTNHSFMCLIKYGHLRVNQTFNWNTTKQEHFPDN

SEQ ID NO: 476 - protein, 101 aa, Artificial Sequence
  CD80 v153 IgV
VIHVTKEVKEVATLSCGHNVSVEELAQTRIYWQKEGKMVMTMMSGDMNIWPEYKNRTIFDITNNLSIVILALRPSDEGTYECVVLKYEKDAFKREHLAEVT

SEQ ID NO: 477 - protein, 107 aa, Artificial Sequence
  CD80 v153 IgV
VIHVTKEVKEVATLSCGHNVSVEELAQTRIYWQKEGKMVMTMMSGDMNIWPEYKNRTIFDITNNLSIVILALRPSDEGTYECVVLKYEKDAFKREHLAEVTLSVKAD

SEQ ID NO: 478 - protein, 237 aa, Artificial Sequence
  ICOSL v36 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTTSINGYPRPNVYWINKTDNSLLDQALQNDTVFLNMRGLYDVVSVLRIARTPSVNIGCCIENVLLQQNLTVGSQTGNDIGERDKIAENPVSTGEKNAAT

What is claimed is:

1. A purified CD80-Fc immunomodulatory protein consisting of a variant CD80 polypeptide, an Fc domain and a linker, wherein the variant CD80 polypeptide is linked to the Fc domain via the linker, and wherein:

the variant CD80 polypeptide comprises a sequence of amino acids that exhibits at least 90% sequence identity to an unmodified CD80 polypeptide set forth in SEQ ID NO: 28, or a portion of SEQ ID NO:28 comprising an IgV domain, wherein the IgV domain is amino acids 35-135, 35-138, 37-138 or 35-141 of SEQ ID NO:1; and the variant CD80 polypeptide comprises the amino acid substitution V68M.

2. The purified CD80-Fc immunomodulatory protein of claim 1, wherein the variant CD80 polypeptide comprises up to 10 amino acid substitutions.

3. The purified CD80-Fc immunomodulatory protein of claim 1, wherein the variant CD80 polypeptide binds non-competitively to the ectodomain of CD28 and PD L1.

4. The purified CD80-Fc immunomodulatory protein of claim 1, wherein the variant CD80 polypeptide specifically binds to the ectodomain of human PD-L1 with increased binding affinity compared to the binding of the unmodified CD80 polypeptide to the ectodomain of human PD-L1.

5. The purified CD80-Fc immunomodulatory protein of claim 4, wherein the increased binding affinity to the ectodomain is increased more than 1.2-fold compared to the binding affinity of the unmodified CD80 polypeptide for the ectodomain.

6. A pharmaceutical composition, comprising the purified CD80-Fc immunomodulatory protein of claim 1, wherein the pharmaceutical composition comprises a pharmaceutically acceptable excipient.

7. The purified CD80-Fc immunomodulatory protein of claim 1, wherein the variant CD80 polypeptide comprises a sequence of amino acids that exhibits at least 90% sequence identity to amino acids 35-141 of SEQ ID NO: 1.

8. The purified CD80-Fc immunomodulatory protein of claim 1 that is a homodimer.

9. A pharmaceutical composition, comprising the purified CD80-Fc immunomodulatory homodimer of claim 8 and a pharmaceutically acceptable excipient.

10. The purified CD80-Fc immunomodulatory protein of claim 1, wherein the Fc domain is a variant Fc domain with reduced effector function.

11. The purified CD80-Fc immunomodulatory protein of claim 10, wherein the variant Fc domain is an IgG1 Fc domain comprising the amino acid substitutions R292C/N297G/V302C.

12. The purified CD80-Fc immunomodulatory protein of claim 11 that is a homodimer.

13. A pharmaceutical composition comprising the purified CD80-Fc immunomodulatory protein of claim 12.

14. A pharmaceutical composition comprising the purified CD80-Fc immunomodulatory protein of claim 11.

15. The purified CD80-Fc immunomodulatory protein of claim 10, wherein the variant Fc domain is an IgG1 Fc domain comprising the amino acid substitutions L234A/L235E/G237A.

16. A pharmaceutical composition comprising the purified CD80-Fc immunomodulatory protein of claim 15.

17. The purified CD80-Fc immunomodulatory protein of claim 15 that is a homodimer.

18. A pharmaceutical composition comprising the purified CD80-Fc immunomodulatory protein of claim 17.

19. A purified CD80-Fc immunomodulatory protein comprising a variant CD80 polypeptide linked to an Fc domain, wherein:

the variant CD80 polypeptide comprises a sequence of amino acids that exhibits at least 90% sequence identity to an unmodified CD80 polypeptide set forth in SEQ ID NO: 28, or a portion of SEQ ID NO:28 comprising an IgV domain, wherein the IgV domain is amino acids 35-135, 35-138, 37-138 or 35-141 of SEQ ID NO:1, the variant CD80 polypeptide comprises the amino acid substitution V68M; and the immunomodulatory protein does not comprise any additional IgSF domain.

20. The purified CD80-Fc immunomodulatory protein of claim 19, wherein the variant CD80 polypeptide comprises up to 10 amino acid substitutions.

21. The purified CD80-Fc immunomodulatory protein of claim 19, wherein the variant CD80 polypeptide comprises a sequence of amino acids that exhibits at least 90% sequence identity to amino acids 35-141 of SEQ ID NO: 1.

22. A pharmaceutical composition, comprising the purified CD80-Fc immunomodulatory protein of claim 19 and a pharmaceutically acceptable excipient.

23. The purified CD80-Fc immunomodulatory protein of claim 19 that is a homodimer.

24. A pharmaceutical composition, comprising the purified CD80-Fc immunomodulatory homodimer of claim 23 and a pharmaceutically acceptable excipient.

25. The purified CD80-Fc immunomodulatory protein of claim 19, wherein the Fc domain is a variant Fc domain with reduced effector function.

26. The purified CD80-Fc immunomodulatory protein of claim 25, wherein the variant Fc domain is an IgG1 Fc domain comprising the amino acid substitutions R292C/N297G/V302C.

27. A pharmaceutical composition comprising the purified CD80-Fc immunomodulatory protein of claim 26.

28. The purified CD80-Fc immunomodulatory protein of claim 26 that is a homodimer.

29. A pharmaceutical composition comprising the purified CD80-Fc immunomodulatory protein of claim 28.

30. The purified CD80-Fc immunomodulatory protein of claim 25, wherein the variant Fc domain is an IgG1 Fc domain comprising the amino acid substitutions L234A/L235E/G237A.

31. A pharmaceutical composition comprising the purified CD80-Fc immunomodulatory protein of claim 30.

32. The purified CD80-Fc immunomodulatory protein of claim 30 that is a homodimer.

33. A pharmaceutical composition comprising the purified CD80-Fc immunomodulatory protein of claim 32.

* * * * *